United States Patent
McGuckin et al.

(10) Patent No.: US 10,695,406 B2
(45) Date of Patent: Jun. 30, 2020

(54) MODULATION OF CELLULAR STRESS USING A B-CELL OXIDATIVE AND/OR ENDOPLASMIC RETICULUM STRESS INHIBITOR AND A TARGETING AGENT

(71) Applicant: THE UNIVERSITY OF QUEENSLAND, St Lucia (AU)

(72) Inventors: Michael McGuckin, Coorparoo (AU); Johannes Prins, Auchenflower (AU); Sumaira Hasnain, Mount Gravatt East (AU)

(73) Assignee: The University of Queensland, Queensland (AU)

( * ) Notice: Subject to any disclaimer, the term of this patent is extended or adjusted under 35 U.S.C. 154(b) by 1 day.

(21) Appl. No.: 15/312,663

(22) PCT Filed: May 27, 2015

(86) PCT No.: PCT/AU2015/050283
§ 371 (c)(1),
(2) Date: Nov. 20, 2016

(87) PCT Pub. No.: WO2015/179918
PCT Pub. Date: Dec. 3, 2015

(65) Prior Publication Data
US 2017/0143798 A1    May 25, 2017

Related U.S. Application Data

(60) Provisional application No. 62/003,492, filed on May 27, 2014.

(51) Int. Cl.
*A61K 38/20* (2006.01)
*C07K 14/54* (2006.01)
*A61K 31/64* (2006.01)
*C07K 16/24* (2006.01)
*C07K 16/28* (2006.01)
*C07K 19/00* (2006.01)
*C07K 14/47* (2006.01)
*C07K 14/72* (2006.01)
*A61K 39/00* (2006.01)

(52) U.S. Cl.
CPC .............. *A61K 38/20* (2013.01); *A61K 31/64* (2013.01); *A61K 38/2066* (2013.01); *C07K 14/47* (2013.01); *C07K 14/54* (2013.01); *C07K 14/5428* (2013.01); *C07K 14/723* (2013.01); *C07K 16/244* (2013.01); *C07K 16/2866* (2013.01); *C07K 19/00* (2013.01); *A61K 2039/505* (2013.01); *C07K 2317/622* (2013.01); *C07K 2317/76* (2013.01); *C07K 2319/00* (2013.01); *C07K 2319/21* (2013.01); *C07K 2319/41* (2013.01)

(58) Field of Classification Search
None
See application file for complete search history.

(56) References Cited

U.S. PATENT DOCUMENTS

| | | |
|---|---|---|
| 5,231,012 A | 7/1993 | Mosmann et al. |
| 5,827,513 A | 10/1998 | Bond et al. |
| 2006/0134112 A1 | 6/2006 | Cua et al. |
| 2006/0275288 A1 | 12/2006 | Grihalde et al. |
| 2011/0262385 A1 | 10/2011 | Huang et al. |
| 2012/0087919 A1 | 4/2012 | Schneider et al. |
| 2012/0288511 A1 | 11/2012 | Dimarchi |
| 2013/0004501 A1 | 1/2013 | Towne et al. |
| 2014/0212428 A1 | 7/2014 | Towne et al. |
| 2015/0183847 A1 | 7/2015 | Qin |

FOREIGN PATENT DOCUMENTS

| | | |
|---|---|---|
| AU | 2013200743 | 3/2013 |
| CA | 2752372 | 4/2012 |
| WO | 2006/068987 | 6/2006 |
| WO | 2006/073508 | 7/2006 |
| WO | 2009/020844 | 2/2009 |
| WO | 2010/096930 | 9/2010 |
| WO | 2013/170636 | 11/2013 |

OTHER PUBLICATIONS

Wells, 1990, Biochemistry 29:8509-8517.*
Bork, 2000, Genome Research 10:398-400.*
Skolnick et al., 2000, Trends in Biotech. 18(1):34-39.*
Doerks et al., 1998, Trends in Genetics 14:248-250.*
Tokuriki and Tawflik, Current Opinion in Structural Biology 2009, 19: 596-604.*
Holst, Physiology Review, 2007, vol. 87, pp. 1409-1439.*
Shioya et al, Pancreas 2008; vol. 36;pp. 197-199.*
Singh et al, Journal of Interferon & Cytokine Research, 2011, vol. 31, No. 10, pp. 711-719.*
Alan J. Garber, Diabetes Care, 2011, vol. 34, supplement 2, pp. s279-s284.*
Int'l Preliminary Report on Patentability for PCT/AU2015/050283, 10 pages, dated Nov. 29, 2016.
Dalmas & Donath "A role for interleukin-22 in the alleviation of metabolic syndrome" *Nature Medicine*, vol. 20, No. 12, pp. 1379-1381 (Dec. 2014).
Hasnain et al. "Glycemic control in diabetes is restored by therapeutic manipulation of cytokines that regulate beta stress" *Nature Medicine*, vol. 20, No. 12, pp. 1417-1426 (Dec. 2014).
Wang et al. "Interleukin-22 alleviates metabolic disorders and restores mucosal immunity in diabetes" *Nature*, vol. 514, No. 7521, pp. 237-241 (Oct. 2014).

(Continued)

*Primary Examiner* — Bridget E Bunner
*Assistant Examiner* — Fozia Hamud
(74) *Attorney, Agent, or Firm* — Nixon & Vanderhye, P.C.

(57) ABSTRACT

Disclosed are compositions and methods for modulating oxidative and/or endoplasmic reticulum (OER) stress. More particularly, the present invention discloses compositions and methods that target OER stress inhibitors to pancreatic cells for treating diseases associated with oxidative and/or OER stress, including metabolic disorders such as diabetes.

18 Claims, 36 Drawing Sheets

Specification includes a Sequence Listing.

(56) References Cited

OTHER PUBLICATIONS

Int'l Search Report for PCT/AU2015/050283, 11 pages (dated Aug. 2015).
Written Opinion of ISA for PCT/AU2015/050283, nine pages (dated Aug. 2015).
Yusta et al. "GLP-1 receptor activation improves R cell function and survival following induction of endoplasmic reticulum stress" *Cell Metabolism*, vol. 4, No. 5, pp. 391-406 (Nov. 2006).
Balla., et al., "In vivo visualization of single native pancreatic islets in the mouse," Contrast Media Mol. Imaging, 8 495-504 (2013).
Sabat, et al., "Therapeutic opportunities of the IL-22—IL-22R1 system," Nature Reviews Drug Discovery, 13 21-38 (2014).
Ueberberg., et al., "Generation of Novel Single-Chain Antibodies by Phage-Display Technology to Direct Imaging Agents Highly Selective to Pancreatic β- or α-Cells In Vivo," Diabetes, vol. 58, 2324-2334 (2009).
Ueberberg., et al., "In vitro phage display in a rat beta cell line: a simple approach for the generation of a single-chain antibody targeting a novel beta cell-specific epitope," Diabetologia 53:1384-1394 (2010).
Ueberberg., et al., "Protection from diabetes development by single-chain antibody-mediated delivery of a NF-κB inhibitor specifically to η-cells in vivo," Am J Physiol Endocrinol Metab 301: E83-E90, (2011).
Weber., et al., "Inhibition of Interleukin-22 Attenuates Bacterial Load and Organ Failure during Acute Polymicrobial Sepsis," Infection and Immunity, 75(4): 1690-1697 (2007).
Hasnain, S. Z., et al., Aug. 29, 2013, "Identification of Cytokines that Cause or Repress ER Stress in β-cells—Therapeutic Manipulation Reverses Hyperglycaemia in Type 2 Diabetes," *Australian Diabetes Society Sydney*, Abstract.
Hasnain, S. Z., et al., Aug. 2013, "Endogenous IL-22 is an Intrinsic Suppressor of β-cell ER Stress and Islet Inflammation and Exogenous IL-22 Restores Glycaemic Control in Obesity," *Australian Islet Study Group Symposium Sydney*, Abstract.
Hasnain, S. Z., et al., Dec. 7, 2013, "Endogenous IL-22 is an Intrinsic Suppressor of β-cell ER Stress and Islet Inflammation and Exogenous IL-22 Restores Glycaemic Control in Obesity," *Immunology of Diabetes Congress Lorne*, Abstract.
Hasnain, S. Z., et al., Dec. 4, 2013, "IL-22 Suppresses Beta-cell Endoplasmic Reticulum Stress and Restores Insulin Production in Type 2 Diabetes," *International Diabetes Federation Congress Melbourne*, Abstract.
Hasnain, S. Z., et al., May 27, 2013, "Improving Insulin Production in Type 2 Diabetes," *ASMR Presentation*.
Nagem, R. A. P., et al., "Interleukin-22 and Its Crystal Structure," *Vitamins and Hormones*, 74:77-103 (2006).
Logsdon, N. J., et al., "The IL-10R2 Binding Hot Spot on IL-22 is Located on the N-terminal Helix and is Dependent on N-linked Glycosylation," *J. Mol. Biol.* 342:503-514 (2004).
Jones, B. C., et al., "Crystallization and preliminary X-ray diffraction analysis of human IL-22 bound to the extracellular IL-22R1 chain," *Acta Crystallographica Section F*, 64:266-269 (2008).
Akpinar, P., et al., "Tmem27: A cleaved and shed plasma membrane protein that stimulates pancreatic β cell proliferation," *Cell Metabolism*, 2:385-397 (2005).
Bartoov-Shifman, R., et al., "Regulation of the Gene Encoding GPR40, a Fatty Acid Receptor Expressed Selectively in Pancreatic β Cells," *The Journal of Biological Chemistry*, 282(32):23561-23571 (2007).
Danzer, C., et al., "Comprehensive Description of the N-Glycoproteome of Mouse Pancreatic β-Cells and Human Islets," *Journal of Proteome Research*, 11:1598-1608 (2012).
Dorrell, C., et al., "Transcriptomes of the major human pancreatic cell types," *Diabetologia*, 54:2832-2844 (2011).
Maffei, A., et al., "Identification of Tissue-Restricted Transcripts in Human Islets," *Endocrinology*, 145(10):4513-4521 (2004).
Stützer, I., et al., "The pancreatic beta cell surface proteome," *Diabetologia*, 55:1877-1889 (2012).
Vats, D., et al., "Multimodal imaging of pancreatic beta cells in vivo by targeting transmembrane protein 27 (TMEM27)," *Diabetologia*, 55:2407-2416 (2012).
Hill T., et al., "The involvement of interleukin-22 in the expression of pancreatic beta cell regenerative Reg genes," Cell Regeneration, 2(1):2 (2013).

\* cited by examiner

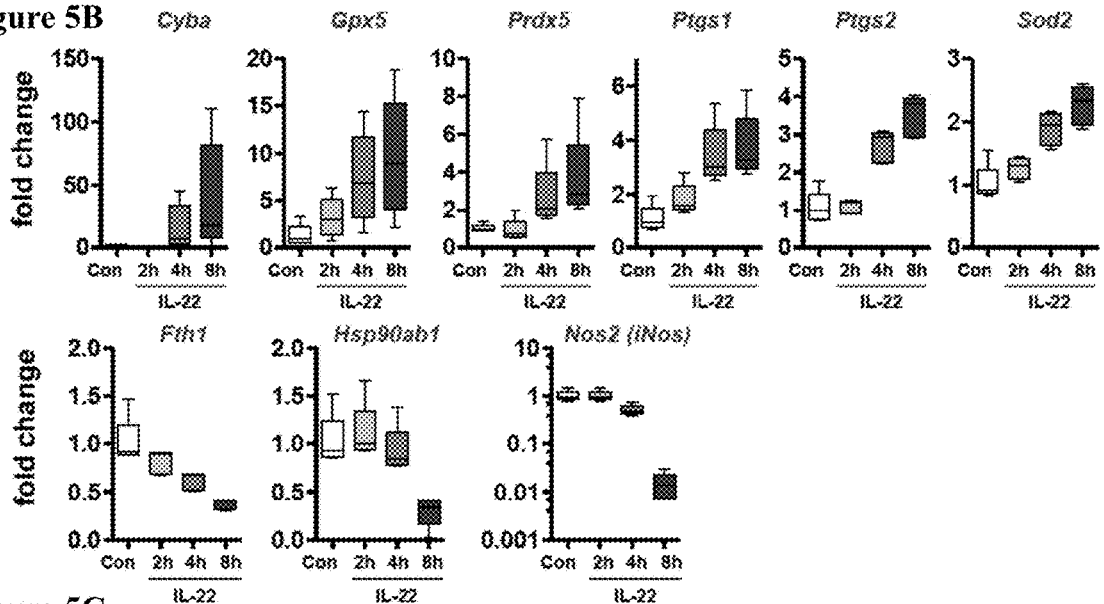

*Genes Regulated by IL-22 (confirmed by qRT-PCR)*
Antioxidants: Glutathione Peroxidase 5 (GPx5); Peroxiredoxin 5 (Prdx5); Prostaglandin-endoperoxide synthase 1, 2 (Ptgs1 (Cox1), Ptgs2 (Cox2)); Superoxide Dismutases (SOD2), Cytochrome b-245 alpha polypeptide (Cyba)
Oxidative stress responsive genes: Nitric Oxide Synthase 2 (Nos2 (iNOS)), Keratin 1 (Krt1), Ferritin Heavy Chain 1 (Fth1), Heat Shock protein 90 ab1 (Hsp90ab1)

*Genes Unaltered by IL-22*
Antioxidants: Gpx1, Gpx2, Gpx3, Gpx4, Gpx6, Gpx7, Gslk1, Gstp1.
Peroxiredoxins (TPx): Ehd2, Prdx1, Prdx2, Prdx3, Prdx4, Prdx6 (Aop2).
Other Peroxidases: Apc, Cat, Ctsb, Duox1, Epx, Lpo, Mpo, Rag2, Serpinb1b, Tpo.
Other Antioxidants: Alb, Gsr, Sod1, Sod3, Srxn1, Txnrd1, Txnrd2, Txnrd3.
Superoxide Dismutases (SOD): Sod1, Sod3.
Genes Involved in Superoxide Metabolism: Ccs, Ncf1, Ncf2, Nox1, Nox4, Noxa1, Noxo1, Recql4, Scd1, Ucp2.
Genes Involved in ROS Metabolism: Aox1, Fmo2, Il19, Il22.
Oxidative Stress Responsive Genes: Als2, Apoe, Cat, Ccl5 (Rantes), Ctsb, Duox1, Epx, Ercc2 (Xpd), Ercc6, Fth1, Gclc, Gclm, Gpx1, Gpx2, Gpx3, Gpx4, Gpx5, Gpx6, Gpx7, Gsr, Gss, Hmox1, Idh1, Mpo, Nqo1, Park7, Prdx1, Prdx2, Prdx6 (Aop2), Prnp, Psmb5, Sod1, Sqstm1, Tpo, Txn1, Txnip, Txnrd1, Txnrd2, Ucp3, Xpa.
Oxygen Tansporters: Atr, Cygb, Dnm2, Fancc, Ift172, Mb, Ngb, Slc38a1, Vim.

Minutes after glucose infusion

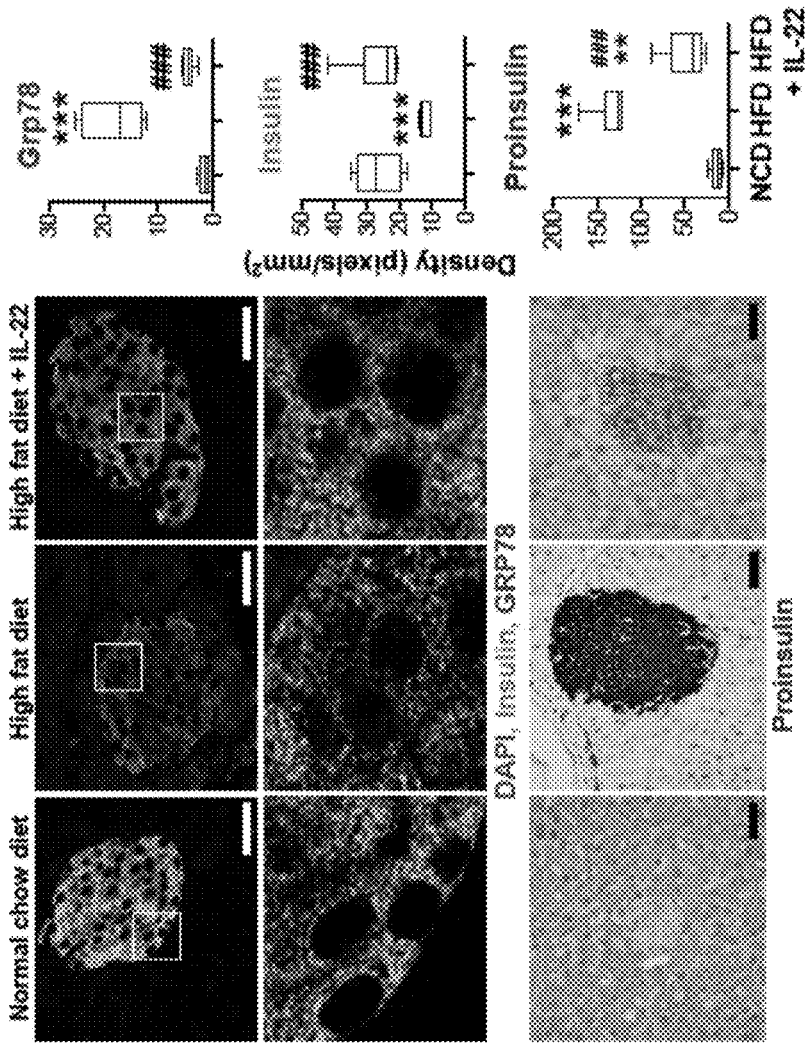
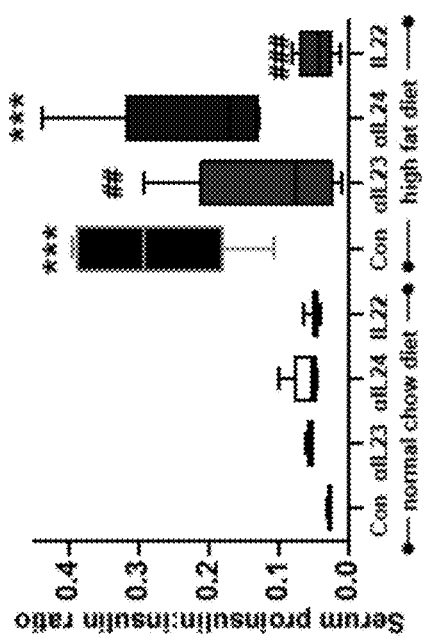
Figure 9J
Figure 9K
Figure 9L

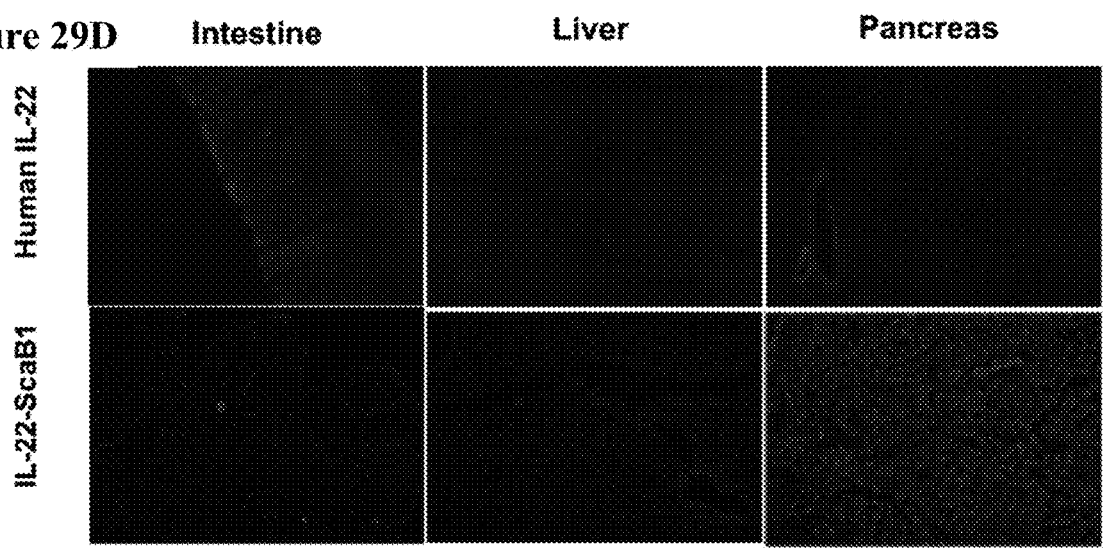

a) EVQLLESGGGLVQPGGSLRLSCAASGFTFSSYAMSWVRQAPGKGLE
WVSSITAEGTHTWYADSVKGRFTISRDNSKNTLYLQMNSLRAEDTAVYY
CAKTSYRFDYWGQGTLVTVSSGGGGSGGGGSGGGGSDIQMTQSPSSL
SASVGDRVTITCRASQSISSYLNWYQQKPGKAPKLLIYKASRLQSGVPSR
FSGSGSGTDFTLTISSLQPEDFATYYCQQKWDPPRTFGQGTKVEIKR [SEQ ID NO:284]

b) APISSHCRLDKSNFQQPYITNRTFMLAKEASLADNNTDVRLIGEKLFHG
VSMSERCYLMKQVLNFTLEEVLFPQSDRFQPYMQEVVPFLARLSNRLST
CHIEGDDLHIQRNVQKLKDTVKKLGESGEIKAIGELDLLFMSLRNACI [SEQ ID NO:4]

c) HHHHHHEVQLLESGGGLVQPGGSLRLSCAASGFTFSSYAMSWVRQA
PGKGLEWVSSITAEGTHTWYADSVKGRFTISRDNSKNTLYLQMNSLRAE
DTAVYYCAKTSYRFDYWGQGTLVTVSSGGGGSGGGGSGGGGSDIQMT
QSPSSLSASVGDRVTITCRASQSISSYLNWYQQKPGKAPKLLIYKASRLQ
SGVPSRFSGSGSGTDFTLTISSLQPEDFATYYCQQKWDPPRTFGQGTKV
EIKRSGGGGSAPISSHCRLDKSNFQQPYITNRTFMLAKEASLADNNTDVR
LIGEKLFHGVSMSERCYLMKQVLNFTLEEVLFPQSDRFQPYMQEVVPFL
ARLSNRLSTCHIEGDDLHIQRNVQKLKDTVKKLGESGEIKAIGELDLLFMS
LRNACIEQKLISEEDLN [SEQ ID NO:285]

FIGURE 34

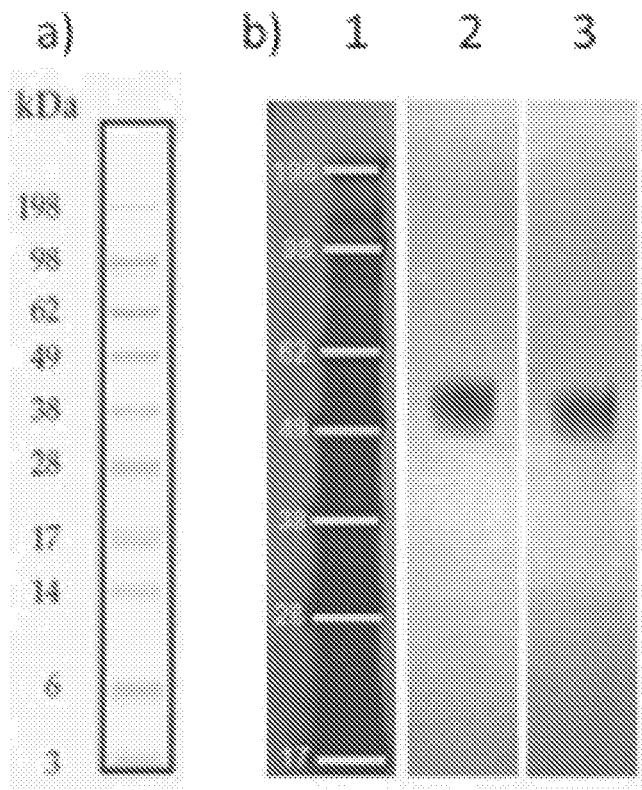

FIGURE 35

MPBS-S0:

EGTFTSDVSSYLEGQAAKEFIAWLVKGRHGEGTFTSDVSSYLEGQAAKEFIAWLVKGRAPISSHCRLDKSN
FQQPYITNRTFMLAKEASLADNNTDVRLIGEKLFHGVSMSERCYLMKQVLNFTLEEVLFPQSDRFQPYMQEV
VPFLARLSNRLSTCHIEGDDLHIQRNVQKLKDTVKKLGESGEIKAIGELDLLFMSLRNACIGGSHHHHHH

[SEQ ID NO:286]

MPBS-S1:

EGTFTSDVSSYLEGQAAKEFIAWLVKGRGGGSSSGGGSSSGGGSSSGGGSSSGAPISSHCRLDKSNFQQ
PYITNRTFMLAKEASLADNNTDVRLIGEKLFHGVSMSERCYLMKQVLNFTLEEVLFPQSDRFQPYMQEVVPF
LARLSNRLSTCHIEGDDLHIQRNVQKLKDTVKKLGESGEIKAIGELDLLFMSLRNACIGGSHHHHHH

[SEQ ID NO:287]

MPBS-S2:

DLSKQMEEEAVRLFIEWLKNGGPSSGAPPPSGGSSSGGGSSSGGGSSSGGGSSSGAPISSHCRLDKSNF
QQPYITNRTFMLAKEASLADNNTDVRLIGEKLFHGVSMSERCYLMKQVLNFTLEEVLFPQSDRFQPYMQEV
VPFLARLSNRLSTCHIEGDDLHIQRNVQKLKDTVKKLGESGEIKAIGELDLLFMSLRNACIGGSHHHHHH

[SEQ ID NO:288]

FIGURE 36

MODULATION OF CELLULAR STRESS USING A B-CELL OXIDATIVE AND/OR ENDOPLASMIC RETICULUM STRESS INHIBITOR AND A TARGETING AGENT

This application is the U.S. national phase of International Application No. PCT/AU2015/050283 filed 27 May 2015, which designates the U.S. and claims priority benefit of Provisional Application No. 62/003,492, filed 27 May 2014, the entire contents of each of which are incorporated herein by reference in their entirety.

The entire content of the ASCII file named "Sequence_Listing.txt" (created on 18 Nov. 2016 and having a size of 762 kb) is incorporated herein by reference. A compliant ASCII text file provides both the paper copy and the computer readable form of the sequence listing.

FIELD OF THE INVENTION

This invention relates generally to compositions and methods for modulating oxidative and/or endoplasmic reticulum (OER) stress. More particularly, the present invention provides compositions and methods for treating diseases associated with oxidative and/or OER stress, including metabolic disorders such as diabetes.

BACKGROUND OF THE INVENTION

Diabetes has rapidly developed into a major global epidemic. In 2011 it was announced that 336 million people worldwide suffer from type 2 diabetes, and this number is expected to grow to around 552 million by 2030. Currently, the disease is responsible for approximately 4.6 million deaths each year (*Diabetes Atlas* published by the *International Diabetes Federation*). Such a high number of instances is creating an unsustainable financial burden to healthcare systems, with treatment circulating over USD$465 billion dollars in 2011, which is a significant 11% of total healthcare expenditure in adults.

Despite current therapies, around 40% of individuals with type 2 diabetes develop a requirement for exogenous insulin administration over time, suggesting that these insulin secretory abnormalities progress after the onset of the disease. Accordingly, there is an obvious and clear need to develop more effective therapies for the treatment of type 2 diabetes, that improve the quality and/or quantity of insulin production, to address this gap in the current treatments.

Pancreatic β-Cell Insulin Secretion

Glucose-induced insulin secretion by pancreatic β-cells is generally schematized by a 'consensus model' that involves the following sequence of events: acceleration of glucose metabolism; closure of ATP-sensitive potassium channels ($K_{ATP}$ channels) in the plasma membrane; depolarization, influx of $Ca^{2+}$ through voltage-dependent calcium channels and a rise in cytosolic-free $Ca^{2+}$ concentration that induces exocytosis of insulin-containing granules (Henguin et al., 2009).

Insulin resistance describes the state where insulin produces an inadequate biological effect, causing decreased insulin-induced muscle and adipose glucose uptake and increased hepatic glucose production. Subjects suffering from type 2 diabetes have some depletion of β-cells and exhibit increased β-cell apoptosis (Butler et al., 2002). However, the extent of β-cell depletion is controversial and trials of bariatric surgery and intense caloric restriction demonstrate that recovery of insulin production is possible in type II diabetics.

Sulfonylurea drugs have been a popular strategy for the development of novel treatments for type 2 diabetes over the last 60 years. This class of drug works by binding directly to the $K_{ATP}$ channel, and thus inducing the secretion of insulin from the β-cells.

Endoplasmic Reticulum (ER) Stress

The ER is a major protein-folding compartment in a eukaryotic cell and is second only to the cytosol, and is the site of synthesis for all secretory and cell surface proteins. Protein folding in the ER is more complex than protein folding in the cytosol because proteins are post-translationally modified. Folding in the ER must couple protein-synthesis pathways operating outside of the compartment with ER-assisted folding (ERAF) pathways in the lumen. Expression of a mutant version of a protein, or even some-wild-type proteins, viral infection, energy or nutrient depletion, extreme environmental conditions, or stimuli that elicit excessive calcium release from the ER lumen compromise protein-folding reactions in the ER, causing unfolded protein to accumulate and initiate a cascade of signals that are transmitted to the cytoplasm and nucleus. When the protein-folding demand on the ER exceeds the folding capacity of the ER a condition termed "ER stress" results (Malhotra et al., 2007). ER stress can also result from other conditions, namely when a protein that is translated in the cytosol is misfolded and induces the recruitment of the folding machinery, leading to a deficit of folding assistance in the ER.

The overproduction of secretory proteins has been demonstrated to generate ER stress and it is well known that pancreatic islet β-cells sustain a high rate of insulin production and secretion. ER stress occurs when protein-misfolding increases beyond threshold levels, releasing a suite of signaling and transcriptional events known collectively as the unfolded protein response (UPR). The ultimate goal of the UPR is to restore ER protein biosynthesis, but paradoxically one initial step is a suppression of translation of the secretory proteins, such as insulin in the β-cell, to relieve ER load. Accordingly, the physical response mechanism, whilst protecting the secretory cell, can have adverse physiological effects. For example, in β-cells this would be a reduction in insulin production and, hence, hyperglycemia. Both β-cell ER stress and insulin misfolding have been reported in both type 2 diabetes and autoimmune type 1 diabetes.

β-cells are long-lived cells that require a highly developed ER in order to produce extremely large amounts of insulin over a long period of time. This insulin generation requires a complex series of molecular biosynthetic events that are initiated in the ER. Pre-pro-insulin, the precursor of mature insulin, is cotranslationally translocated in the ER lumen, where the signal sequence is cleaved and proinsulin is generated. Machinery enzymes in the ER catalyze the formation of three disulfide bonds, to help form its native shape, before being trafficked to the Golgi apparatus and secretory granules. Finally, in the downstream Golgi it is further processed by endoproteases and the C-peptide is removed, generating the final product, mature insulin.

Potential contributors to β-cell ER stress in type 2 diabetes include increased insulin biosynthesis, lipotoxicity due to saturated long chain free fatty acids (FFA) such as palmitate (a side effect of obesity), increased reactive oxygen species (ROS) production in the ER due to increased disulfide bond formation and by mitochondria due to high glucose, and progressive accumulation of amyloid deposits (Cnop et al., 2012, Cunha et al., 2008).

The precise molecular mechanisms governing how insulin resistance interrelates to β-cell dysfunction are currently not well understood, with many obese individuals being highly insulin resistant without developing β-cell dysfunction and diabetes. However, insulin resistance adds to the demand for increased insulin biosynthesis in β-cells. Furthermore, the inappropriate secretion of the proinsulin precursor by β-cells, which increases as diabetes progresses, is thought to contribute to increased insulin resistance. Loss of cyclicity of insulin release from the pancreas also occurs in diabetes and contributes to increasing insulin resistance. Oxidative stress, ER stress, amyloid deposition in the pancreas, as well as both lipotoxicity and glucotoxicity are believed to play a role in progressive β-cell dysfunction, and are all caused by over-nutrition.

IL-22 Treatment

Huang et al. (U.S. 2010/0015086) have shown that injection of recombinant IL-22 (rIL-22) can reduce total serum glucose, triglyceride and insulin levels as well as body weight in obese mice. They have also shown that systemic administration of rIL-22 can improve glucose tolerance and insulin sensitivity in normal mice. Based on these observations, Huang et al. propose that rIL-22 would be useful for treating metabolic disorders including obesity, diabetes, hyperlipidemia, hyperglycemia and hyperinsulinemia. However, Huang et al. do not disclose any mechanism of action to explain how rIL-22 achieves these effects.

The present inventors observe, however, that no clinical trials have been published that support the use of systemic administration of rIL-22 for treating metabolic disorders in humans since publication of Huang et al. and that this may be due to possible off-target effects of rIL-22. For example, chronic high concentrations of IL-22, and low concentrations of the counteracting IL-22 binding protein (Dumoutier et al., 2001), have been shown to contribute to hyperplasia and tumor development in the intestine in animal models (Huber et al., 2012; Kirchberger et al., 2013; Yu et al., 2013; Jiang et al., 2013). IL-22 has also been reported to induce hepatocyte proliferation and overexpression of IL-22 in the liver has been shown to increase the rate of carcinogen-induced liver cancers (Park et al., 2011). It has also been reported that IL-22 is associated with human hepatocarcinomas, and that carcinogen-induced liver cancers are reduced in IL-22 knockout mice (Jiang et al., 2011). IL-22-producing CD8 T cells have been found associated with transplant-associated skin cancers and possibly contribute to squamous cell carcinoma growth or development in this setting (Zhang et al., 2013). As shown herein, the present inventors have also discovered that systemic administration of rIL-22 has the potential to exacerbate viral infections in humans.

SUMMARY OF THE INVENTION

The present invention arises, in part, from the unexpected discovery that specific cytokines including IL-22 inhibit oxidative and endoplasmic reticulum (OER) stress in pancreatic β-cells, whist others including IL-23 and IL-24 actively increase it. In particular, the present inventors found that blockade of IL-23 or IL-24 improves pancreatic ER function, insulin biosynthesis and glucose tolerance. By contrast, they found that IL-22 is a powerful endogenous suppressor of β-cell OER stress in response to cytokines, lipids and protein misfolding agents. Significantly, IL-22 administration to obese animals was found to modulate oxidative stress regulatory genes, reduce ER stress and promote secretion of high quality efficacious insulin, which restores glucose homeostasis before subsequent restitution of peripheral insulin sensitivity. Based on these findings and their observations that rIL-22 may have significant side effects when administered systemically, the present inventors propose that targeting β-cell OER stress inhibitors such as IL-22 directly to pancreatic β-cells will be useful for treating diseases associated with aberrant β-cell OER stress, including diabetes and other metabolic disorders, with reduced off-target effects, as described hereafter.

Accordingly, in one aspect, the present invention provides therapeutic agents, which are suitably useful for reducing OER stress in a pancreatic β-cell (hereafter referred to as "β-cell"). These therapeutic agents generally comprise, consist, or consist essentially of a β-cell OER stress inhibitor and a targeting agent that targets the inhibitor to a β-cell. In specific embodiments, the β-cell OER stress inhibitor is selected from the group consisting of: an IL-22 polypeptide, an IL-10 polypeptide, or an antagonist of IL-23, IL-24, IL-33, IL-1β, MIP-2α, IL-17A, IFN-γ or IFN-β. The β-cell OER stress inhibitor is preferably an IL-22 polypeptide. In other embodiments, the β-cell OER stress inhibitor is selected from antagonists of IL-23 or IL-24.

Suitably, the targeting agent binds a β-cell protein (e.g., a β-cell surface protein). In some embodiments, the β-cell protein is a β-cell receptor (e.g., sulfonylurea receptor 1 (SUR1), glucagon-like peptide 1 receptor (GLP-1R) or a G-protein-coupled receptor (e.g., GPR40, GPR119). The targeting agent is suitably selected from proteinaceous molecules (e.g., peptides, polypeptides) and small molecules.

In some embodiments, the targeting agent is a SUR1 ligand. The SUR1 ligand is suitably a SUR1 agonist. Representative SUR1 ligands include α-endosulfine, an antigen-binding molecule that is immuno-interactive with SUR1, and sulfonylurea compounds, illustrative examples of which include carbutamide, acetohexamide, chloropropamide, tolbutamide, tolazamide, glipizide, gliclazide, glibenclamide, glibornuride, gliquidone, glisoxepide, glyclopyramide, and glimepiride.

In other embodiments, the targeting agent is a GLP-1R ligand. Suitably, the GLP-1R ligand is a GLP-1R agonist. Non-limiting examples of GLP-1R ligands include glucagon-like peptide 1 (GLP-1), exendin-4, gastric inhibitory polypeptide, glucagon, taspoglutide, liraglutide, an antigen-binding molecule that is immuno-interactive with GLP-1R, and small molecule ligands such as hydroxylflavonol compounds (e.g., quercetin).

In still other embodiments, the targeting agent is a G-protein-coupled receptor (e.g., GPR40 or GPR119) ligand. Illustrative examples of this type include AMG-837, TAK-875, LY2881835, HD0471042 and HD0471953.

In still other embodiments, the targeting agent is an antigen-binding molecule that is immuno-interactive with a β-cell protein (e.g., a β-cell surface protein), which may or may not be characterized.

The targeting agent is suitably attached to the β-cell OER stress inhibitor either directly or indirectly (e.g., via an intervening linker to the N-terminus or the C-terminus of the β-cell OER stress inhibitor). Alternatively, the targeting agent and the β-cell OER stress inhibitor are attached to or otherwise comprised in a delivery vehicle (e.g., a particle, a dendrimer or a cyclodextrin).

In another aspect, the present invention provides pharmaceutical compositions that generally comprise a therapeutic agent as broadly described above and elsewhere herein, and a pharmaceutically acceptable carrier, excipient or diluent.

Yet another aspect of the present invention provides methods for inhibiting or reducing OER stress in a β-cell. These methods generally comprise, consist or consist essentially of contacting the β-cell with a therapeutic agent as broadly described above and elsewhere herein such that the targeting agent binds to the β-cell and the β-cell OER stress inhibitor inhibits or reduces OER stress in the β-cell.

In still another aspect, the present invention provides methods of treating a metabolic disorder in a subject. These methods generally comprise, consist or consist essentially of administering to the subject an effective amount of a therapeutic agent as broadly described above or elsewhere herein. Representative metabolic disorders include pre-diabetes, diabetes (type I or type II), metabolic syndrome, obesity, non-alcoholic fatty liver disease (NAFLD), non-alcoholic steatohepatitis (NASH), diabetic dyslipidemia, hyperlipidemia, hypertension, hypertriglyceridemia, hyperfattyacidemia, and hyperinsulinemia.

In some embodiments, the methods further comprise administering concurrently to the subject at least one ancillary agent for treating the metabolic disorder. In specific embodiments, the at least one ancillary agent is selected from an antidiabetic agent (e.g., metformin, glyburide, glimepiride, glipyride, glipizide, chlorpropamide, gliclazide, acarbose, miglitol, pioglitazone, troglitazone, dapagliflozin, rosiglitazone, insulin, GI-262570, isaglitazone, JTT-501, NN-2344, L895645, YM-440, R-119702, AJ9677, repaglinide, nateglinide, KAD1129, APR-H039242, GW-409544, KRP297, AC2993, Exendin-4, LY307161, NN2211 or LY315902), an anti-obesity agent (e.g., Orlistat, ATL-962, AJ9677, L750355, CP331648, sibutramine, topiramate, axokine, dexamphetamine, phentermine, phenylpropanolamine, famoxin, or mazindol) or a lipid-modulating agent (e.g., pravastatin, lovastatin, simvastatin, atorvastatin, cerivastatin, fluvastatin, nisvastatin, ZD-4522, fenofibrate, gemfibrozil, clofibrate, implitapide, CP-529,414, avasimibe, TS-962, MD-700, or LY295427).

The therapeutic agents and methods of the present invention are useful for promoting insulin secretion from a β-cell, improving the quality of insulin produced from a β-cell and/or slowing or reducing β-cell degeneration, and/or for promoting β-cell regeneration, including following pancreatic islet transplantation.

BRIEF DESCRIPTION OF THE DRAWINGS

FIGS. 5A-5C: Assessment of oxidative stress genes influenced by IL-22. (FIG. 5A) MIN6N8 cells were treated with DMSO (control) or IL-22 and analyzed using Oxidative Stress RT2 Profiler PCR Array. Genes upregulated (above the 2-fold upregulated line) or downregulated (below the 2-fold downregulated line) are shown above. (FIG. 5B) Alteration in the expression of oxidative stress genes was confirmed by qRT-PCR in MIN6N8 cells treated with DMSO (control) or IL-22. (FIG. 5C) List of genes in the array that were and were not regulated by IL-22.

FIGS. 9A-9L: Targeting cytokine-induced ER stress in HFDIO improves glucose tolerance and hyperinsulinemia. HFDIO Experiment 1: Mice were fed a high fat diet (HFD) or normal chow diet (NCD) for 16 weeks and treated for the last 3 weeks with (FIGS. 9A-C) IL-22, (FIGS. 9D-F) anti-IL-24, or (FIGS. 9G-I) anti-IL-23. NCD and HFD control mice received an irrelevant IgG control antibody. Blood glucose (FIGS. 9A, D, G) and serum total insulin (FIGS. 9C, F, I) during fasted i.p. glucose tolerance tests on day 14 of treatment, and blood glucose during insulin tolerance tests on day 16 (FIGS. 9B, E, H) are shown. Fasting serum proinsulin:insulin ratio (FIG. 9J) and total pancreatic sXbp1 mRNA (FIG. 9K) at the end of treatment. (FIG. 9L) Co-staining of total insulin and Grp78 analyzed by confocal-microscopy (upper panels) and immunohistochemical staining of proinsulin (lower panel) in pancreata from control and IL-22-treated mice. Graphs show quantification of Grp78, total insulin and proinsulin in the core β-cell rich area of islets. Scale bars=50 μm. Color reproductions of FIG. 9 are available upon request.

FIGS. 29A-29D: Assessment of specific targeting to the pancreatic islets of IL-22-ScaB1. IL-22 receptor expressing tissues (liver, intestine, skin and pancreas) from mice treated with 15.4 nmoles/g of recombinant human IL-22 or 0.96, 3.8 or 15.4 nmoles/g of the IL-22-ScaB1 fusion protein for 30 min were stained with pStat3 antibody. The intensity of fluorescence per area was assessed using image J software in 3-4 fields of view for each tissue in each mouse (n=3). Within each mouse the mean fluorescence density from multiple fields was calculated for each tissue and then the ratio of pancreatic islet staining intensity in each of the other tissues (FIG. 29A; liver, FIG. 29B; intestine, FIG. 29C; skin)

was calculated. Results are presented as fold change relative to that observed with recombinant human IL-22 (rhIL-22). FIG. 29D shows pStat3 with human IL-22 (15.4 nmoles/g) and IL-22-ScaB1 (15.4 nmoles/g) in the intestine, liver and pancreas.

FIG. 34: Amino acid sequences of IL-22-ScaB1 constructs and component parts. a) ScaB1 scFv sequence includes the variable heavy (VH) chain in grey and the black is the variable light or Kappa (VL or VK) chain. The Glycine-Serine motif between the two domains forms the flexible linker, (G4S)3, which allows the scFv to fold into a functional targeting moiety. b) Final sequence used as the human IL22 domain. c) Sequence showing design of initial fusion construct (His-ScaB1 scFv-IL22 human-myc) with flanking tags to aid in detection.

FIG. 35: PAGE gel of purified His-ScaB1 scFv-IL22 human-myc. a) Illustration of SeeBlue Plus2 pre-stained protein standard (Life technologies). b) Lane 1 shows the protein standard, lane 2 is of reduced protein and lane 3 is of the non-reduced protein.

FIG. 36: Amino acid sequences of IL-22-GLP-1R ligand fusion proteins. Amino acid sequences of MPBS-50, MPBS-51 and MPBS-52 fusion proteins.

DETAILED DESCRIPTION OF THE INVENTION

1. Definitions

Figure 1:
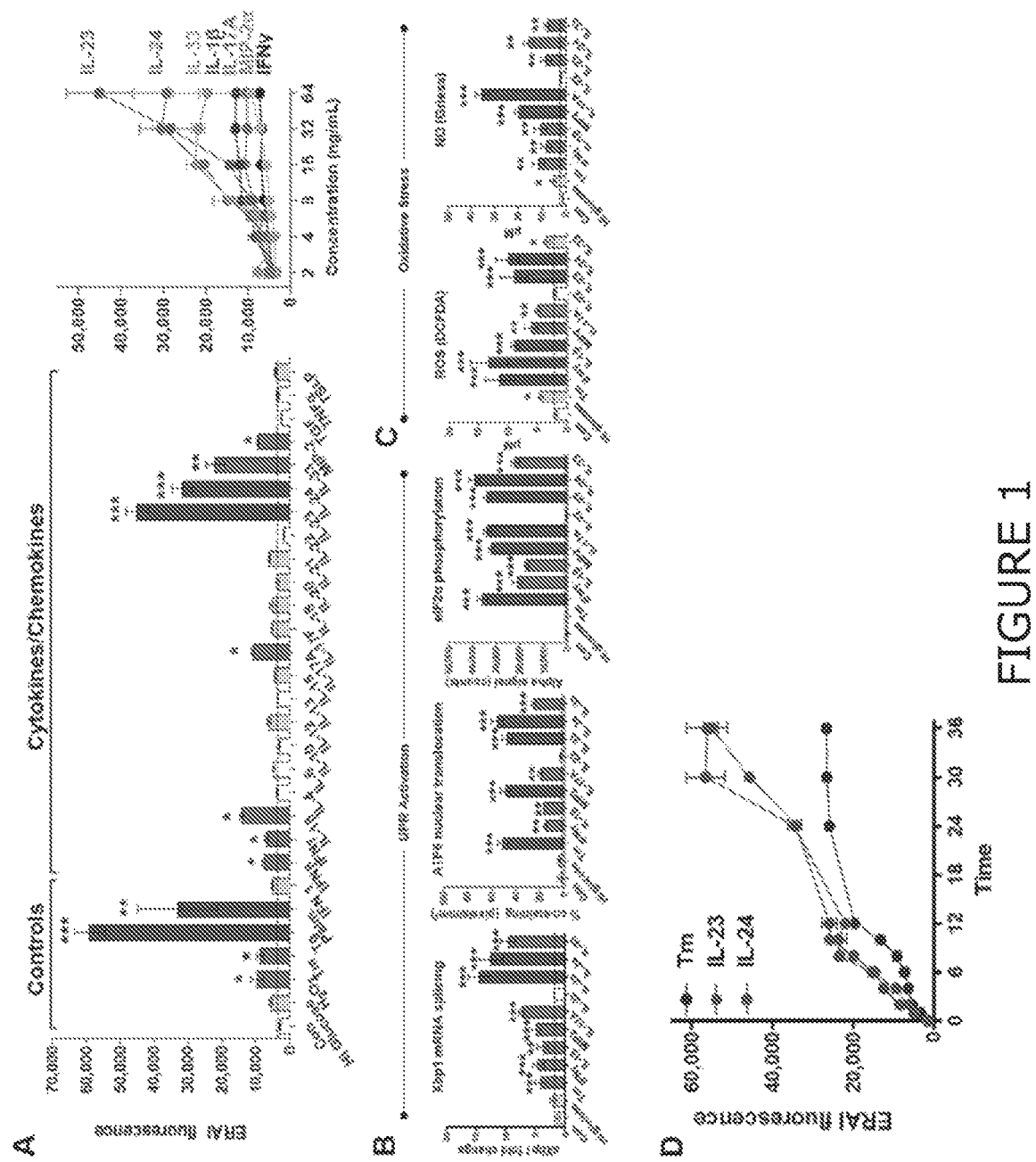
FIG. 1: Cytokines induce ER stress in murine pancreatic β-cells. (A) ERAI-XBP1-reporter fluorescence in MIN6N8 murine insulinoma β-cells after 24 hour treatment with 16.6 mM glucose (Hi glucose), 10 μM $H_2O_2$, 0.5 mM palmitic acid or 50 ng/mL cytokines, or 6 hour treatment with 10 μg/mL tunicamycin (Tm) or 5 μM thapsigargin (Tg). Right panel shows dose-response curves for stressor cytokines from 2-64 ng/mL. (B) MIN6N8 cells exposed to Tm, Hi glucose or cytokines as in (a) and qRT-PCR used to assess splicing of the Xbp1 mRNA, transfected with ATF6-GFP and nuclear translocation of activated ATF6 quantified, or an ALPHASCREEN assay used to assess eIF2α phosphorylation. (C) Peak production of reactive oxygen species (ROS) and nitric oxide (NO) in MIN6N8 cells treated as in (A) from a 30 min to 8 hour time course. (D) ER stress inducing cytokines progressively activate the unfolded protein response. MIN6N8 murine β-cells were transfected with the ERAI reporter and exposed to tunicamycin (Tm, 10 μg/mL), IL-23 or IL-24 (50 ng/mL) and GFP fluorescence assessed at regular intervals over 36 hours. MIN6N8 vehicle control (Con)=DMSO. Box-plots show median/IQR/range; histograms show mean±SEM; ANOVA, Bonferroni post-hoc test; *$P<0.05$, $P<0.01$, *$P<0.001$ (from post-hoc test); * vs untreated vehicle control.

Unless defined otherwise, all technical and scientific terms used herein have the same meaning as commonly understood by those of ordinary skill in the art to which the invention belongs. Although any methods and materials similar or equivalent to those described herein can be used in the practice or testing of the present invention, preferred methods and materials are described. For the purposes of the present invention, the following terms are defined below.

The articles "a" and "an" are used herein to refer to one or to more than one (i.e. to at least one) of the grammatical object of the article. By way of example, "an element" means one element or more than one element.

By "about" is meant a quantity, level, value, number, frequency, percentage, dimension, size, amount, weight or length that varies by as much 15, 14, 13, 12, 11, 10, 9, 8, 7, 6, 5, 4, 3, 2 or 1% to a reference quantity, level, value, number, frequency, percentage, dimension, size, amount, weight or length.

The terms "administration concurrently" or "administering concurrently" or "co-administering" and the like refer to the administration of a single composition containing two or more actives, or the administration of each active as separate compositions and/or delivered by separate routes either contemporaneously or simultaneously or sequentially within a short enough period of time that the effective result is equivalent to that obtained when all such actives are administered as a single composition. By "simultaneously" is meant that the active agents are administered at substantially the same time, and desirably together in the same formulation. By "contemporaneously" it is meant that the active agents are administered closely in time, e.g., one agent is administered within from about one minute to within about one day before or after another. Any contemporaneous time is useful. However, it will often be the case that when not administered simultaneously, the agents will be administered within about one minute to within about eight hours and preferably within less than about one to about four hours. When administered contemporaneously, the agents are suitably administered at the same site on the subject. The term "same site" includes the exact location, but can be within about 0.5 to about 15 centimeters, preferably from within about 0.5 to about 5 centimeters. The term "separately" as used herein means that the agents are administered at an interval, for example at an interval of about a day to several weeks or months. The active agents may be administered in either order. The term "sequentially" as used herein means that the agents are administered in sequence, for example at an interval or intervals of minutes, hours, days or weeks. If appropriate the active agents may be administered in a regular repeating cycle.

By "antigen-binding molecule" is meant a molecule that has binding affinity for a target antigen. It will be understood that this term extends to immunoglobulins, immunoglobulin fragments and non-immunoglobulin derived protein frameworks that exhibit antigen-binding activity. Representative antigen-binding molecules that are useful in the practice of the present invention include polyclonal and monoclonal antibodies as well as their fragments (such as Fab, Fab', F(ab')$_2$, Fv), single chain (scFv) and domain antibodies (including, for example, shark and camelid antibodies), and fusion proteins comprising an antibody, and any other modified configuration of the immunoglobulin molecule that comprises an antigen binding/recognition site. An antibody includes an antibody of any class, such as IgG, IgA, or IgM (or sub-class thereof), and the antibody need not be of any particular class. Depending on the antibody amino acid sequence of the constant region of its heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA1 and IgA2. The heavy-chain constant regions that correspond to the different classes of immunoglobulins are called alpha, delta, epsilon, gamma, and mu, respectively. The subunit structures and three-dimensional configurations of different classes of immunoglobulins are well known. Antigen-binding molecules also encompass dimeric antibodies, as well as multivalent forms of antibodies. In some embodiments, the antigen-binding molecules are chimeric antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (see, for example, U.S. Pat. No. 4,816,567; and Morrison et al., 1984, Proc. Natl. Acad. Sci. USA, 81:6851-6855). Also contemplated, are humanized antibodies, which are generally produced by transferring complementarity determining regions (CDRs) from heavy and light variable chains of a non-human (e.g., rodent, preferably mouse) immunoglobulin into a human variable domain. Typical residues of human antibodies are then substituted in the framework regions of the non-human counterparts. The use of antibody components derived from humanized antibodies obviates potential problems associated with the immunogenicity of non-human constant regions. General techniques for cloning non-human, particularly murine, immunoglobulin variable domains are described, for example, by Orlandi et al. (1989, Proc. Natl. Acad. Sci. USA 86: 3833). Techniques for producing humanized monoclonal antibodies are described, for example, by Jones et al. (1986, Nature 321:522), Carter et al. (1992, Proc. Natl. Acad. Sci. USA 89: 4285), Sandhu (1992, Crit. Rev. Biotech. 12: 437), Singer et al. (1993, J. Immun. 150: 2844), Sudhir (ed., Antibody Engineering Protocols, Humana Press, Inc. 1995), Kelley ("Engineering Therapeutic Antibodies," in Protein Engineering: Principles and Practice Cleland et al. (eds.), pages 399-434 (John Wiley & Sons, Inc. 1996), and by Queen et al., U.S. Pat. No. 5,693,762 (1997). Humanized antibodies include "primatized" antibodies in which the antigen-binding region of the antibody is derived from an antibody produced by immunizing macaque monkeys with the antigen of interest. Also contemplated as antigen-binding molecules are humanized antibodies.

The terms "beta-cell," "β-cell" or "pancreatic β-cell" are used interchangeably herein to refer to cells in the pancreatic islets that are of the lineage of cells that produce insulin in response to glucose. β-cells are found in the islets of Langerhans in the pancreas.

The term "biologically active fragment," as applied to fragments of a reference or full-length polynucleotide or polypeptide sequence, refers to a fragment that has at least about 0.1, 0.5, 1, 2, 5, 10, 12, 14, 16, 18, 20, 22, 24, 26, 28, 30, 35, 40, 45, 50, 55, 60, 65, 70, 75, 80, 85, 90, 95, 96, 97, 98, 99% of the activity of a reference sequence. Suitably, the biologically active fragment has no less than about 1%, 10%, 25% 50% of an activity of the full-length polypeptide from which it is derived. Included within the scope of the present invention are biologically active fragments of at least about 18, 19, 20, 21, 22, 23, 24, 25, 26, 27, 28, 29, 30, 40, 50, 60, 70, 80, 90, 100, 120, 140, 160, 180, 200, 250, 300, 400, 500, 600, 700, 800, 900, 1000, 1500, 2000 nucleotides or residues in length, which comprise or encode an activity of a reference polynucleotide or polypeptide. Representative biologically active fragments generally participate in an interaction, e.g., an intra-molecular or an inter-molecular interaction. An inter-molecular interaction can be a specific binding interaction or an enzymatic interaction (e.g., the interaction can be transient and a covalent bond is formed or broken). For instance, biologically active fragments of a full-length IL-22 or IL-10 polypeptide include peptides comprising amino acid sequences sufficiently similar to or derived from the amino acid sequences of a (putative) full-length precursor or mature IL-22 or IL-10 polypeptide. For example, biologically active portions of a full-length precursor or mature IL-22 or IL-10 polypeptide include peptides or polypeptides comprising amino acid sequences with sufficient similarity or identity to or derived from the amino acid sequence of a full-length precursor or mature IL-22 or IL-10 polypeptide, as for example set forth in SEQ ID NO: 2, 4, 6, or 8 and comprises at least one domain or motif capable of inhibiting OER stress. In some embodiments, the biologically active portions comprise at least one domain or motif capable of activating the IL-22 receptor (IL-22R) or IL-10 receptor (IL-10R).

Throughout this specification, unless the context requires otherwise, the words "comprise," "comprises" and "comprising" will be understood to imply the inclusion of a stated step or element or group of steps or elements but not the exclusion of any other step or element or group of steps or elements. Thus, use of the term "comprising" and the like indicates that the listed elements are required or mandatory, but that other elements are optional and may or may not be present. By "consisting of" is meant including, and limited to, whatever follows the phrase "consisting of". Thus, the phrase "consisting of" indicates that the listed elements are required or mandatory, and that no other elements may be present. By "consisting essentially of" is meant including any elements listed after the phrase, and limited to other elements that do not interfere with or contribute to the activity or action specified in the disclosure for the listed elements. Thus, the phrase "consisting essentially of" indicates that the listed elements are required or mandatory, but that other elements are optional and may or may not be present depending upon whether or not they affect the activity or action of the listed elements.

A "conservative amino acid substitution" is one in which the amino acid residue is replaced with an amino acid residue having a similar side chain. Families of amino acid residues having similar side chains have been defined in the art, which can be generally sub-classified as follows:

TABLE 1

AMINO ACID SUB-CLASSIFICATION

| SUB-CLASSES | AMINO ACIDS |
| --- | --- |
| Acidic | Aspartic acid, Glutamic acid |
| Basic | Noncyclic: Arginine, Lysine; Cyclic: Histidine |
| Charged | Aspartic acid, Glutamic acid, Arginine, Lysine, Histidine |
| Small | Glycine, Serine, Alanine, Threonine, Proline |
| Polar/neutral | Asparagine, Histidine, Glutamine, Cysteine, Serine, Threonine |
| Polar/large | Asparagine, Glutamine |
| Hydrophobic | Tyrosine, Valine, Isoleucine, Leucine, Methionine, Phenylalanine, Tryptophan |
| Aromatic | Tryptophan, Tyrosine, Phenylalanine |
| Residues that influence chain orientation | Glycine and Proline |

Conservative amino acid substitution also includes groupings based on side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. For example, it is reasonable to expect that replacement of a leucine with an isoleucine or valine, an aspartate with a glutamate, a threonine with a serine, or a similar replacement of an amino acid with a structurally related amino acid will not have a major effect on the properties of the resulting variant polypeptide. Whether an amino acid change results in a functional polypeptide can readily be determined by assaying its activity. Conservative substitutions are shown in Table 2 under the heading of exemplary and preferred substitutions. Amino acid substitutions falling within the scope of the invention, are, in general, accomplished by selecting substitutions that do not differ significantly in their effect on maintaining (a) the structure of the peptide backbone in the area of the substitution, (b) the charge or hydrophobicity of the molecule at the target site, or (c) the bulk of the side chain. After the substitutions are introduced, the variants are screened for biological activity.

Table 2

TABLE 2

EXEMPLARY AND PREFERRED AMINO ACID SUBSTITUTIONS

| ORIGINAL RESIDUE | EXEMPLARY SUBSTITUTIONS | PREFERRED SUBSTITUTIONS |
|---|---|---|
| Ala | Val, Leu, Ile | Val |
| Arg | Lys, Gln, Asn | Lys |
| Asn | Gln, His, Lys, Arg | Gln |
| Asp | Glu | Glu |
| Cys | Ser | Ser |
| Gln | Asn, His, Lys, | Asn |
| Glu | Asp, Lys | Asp |
| Gly | Pro | Pro |
| His | Asn, Gln, Lys, Arg | Arg |
| Ile | Leu, Val, Met, Ala, Phe, Norleu | Leu |
| Leu | Norleu, Ile, Val, Met, Ala, Phe | Ile |
| Lys | Arg, Gln, Asn | Arg |
| Met | Leu, Ile, Phe | Leu |
| Phe | Leu, Val, Ile, Ala | Leu |
| Pro | Gly | Gly |
| Ser | Thr | Thr |
| Thr | Ser | Ser |
| Trp | Tyr | Tyr |
| Tyr | Trp, Phe, Thr, Ser | Phe |
| Val | Ile, Leu, Met, Phe, Ala, Norleu | Leu |

By "corresponds to" or "corresponding to" is meant an amino acid sequence that displays substantial sequence similarity or identity to a reference amino acid sequence. In general the amino acid sequence will display at least about 70, 71, 72, 73, 74, 75, 76, 77, 78, 79, 80, 81, 82, 83, 84, 85, 86, 97, 88, 89, 90, 91, 92, 93, 94, 95, 96, 97, 98, 99% or even up to 100% sequence similarity or identity to at least a portion of the reference amino acid sequence "Diabetic dyslipidemia" or "Type 2 diabetes with dyslipidemia" means a condition characterized by Type 2 diabetes, reduced HDL-C, elevated serum triglycerides, and elevated small, dense LDL particles.

By "effective amount," in the context of inhibiting ER stress or treating or preventing a disease or condition, is meant the administration of an amount of agent to an individual in need thereof, either in a single dose or as part of a series, that is effective for that inhibition, treatment or prevention. The effective amount will vary depending upon the health and physical condition of the individual to be treated, the taxonomic group of individual to be treated, the formulation of the composition, the assessment of the medical situation, and other relevant factors. It is expected that the amount will fall in a relatively broad range that can be determined through routine trials.

The term "ER stress" refers to the biochemical state and cellular response associated with (e.g., caused by, correlated with, or induced by) protein misfolding or other disturbances to normal physiology within the endoplasmic reticulum. These cellular responses include, but are not limited to, gene expression, protein translation/expression, and protein degradation. Various methodologies described herein include steps that involve determining or comparing levels of ER stress signaling. Methods for determining levels of ER stress are known in the art. For example, methods for measuring ER stress signaling are described in U.S. Pat. Publication No. 20070202544, the contents of which are incorporated herein by reference. Example 1 herein also describes exemplary methods for measuring level of ER stress. For example, expression levels of ER stress response genes, e.g., expression and splicing of the Xbp-1 mRNA can be measured.

The term "euglycemia" is defined as the condition in which a subject has a fasting blood glucose concentration within the normal range, greater than 70 mg/dL (3.89 mmol/L) and less than 100 mg/dL (5.6 mmol/L).

By "gene" is meant a unit of inheritance that occupies a specific locus on a chromosome and consists of transcriptional and/or translational regulatory sequences and/or a coding region and/or non-translated sequences (i.e., introns, 5' and 3' untranslated sequences).

As used herein, the term "hyperfattyacidemia" refers to a condition characterized by elevated fatty acid levels. Exemplary total fatty acid levels considered abnormally elevated in a human subject is 0.72 mmol/L and above.

The term "hyperlipidemia" refers to the presence of an abnormally elevated level of lipids in the blood. Hyperlipidemia can appear in at least three for MS (ES): (1) hypercholesterolemia, i.e., an elevated LDL cholesterol level (120 mg/dL and above); (2) hypertriglyceridemia, i.e., an elevated triglyceride level; (150 mg/dL and above) and (3) combined hyperlipidemia, i.e., a combination of hypercholesterolemia and hypertriglyceridemia.

The term "hypertension" as used herein includes essential, or primary, hypertension wherein the cause is not known or where hypertension is due to greater than one cause, such as changes in both the heart and blood vessels; and secondary hypertension wherein the cause is known. Causes of secondary hypertension include, but are not limited to obesity; kidney disease; hormonal disorders; use of certain drugs, such as oral contraceptives, corticosteroids, cyclosporine, and the like. The term "hypertension" encompasses high blood pressure, in which both the systolic and diastolic pressure levels are elevated 140 mmHg/90 mmHg), and isolated systolic hypertension, in which only the systolic pressure is elevated to greater than or equal to 140 mm Hg, while the diastolic pressure is less than 90 mm Hg. Normal blood pressure may be defined as less than 120 mmHg systolic and less than 80 mmHg diastolic.

As used herein, the term "hypertriglyceridemia" refers to a condition characterized by elevated triglyceride levels. Exemplary total triglyceride levels considered abnormally elevated in a human subject is 150 mg/dL and above.

The term "hyperinsulinemia" is defined as the condition in which a subject with insulin resistance, with or without euglycemia, has fasting or postprandial serum or plasma insulin concentration elevated above that of normal, lean individuals without insulin resistance, having a waist-to-hip ratio<1.0 (for men) or <0.8 (for women).

The term "IL-10 polypeptide," as used herein encompasses, without limitation, polypeptides having an amino acid sequence that shares at least 70% (and at least 71% to at least 99% and all integer percentages in between) sequence identity or similarity with the sequence set forth in any one of SEQ ID NO: 4. It further encompasses natural allelic variation of IL-10 polypeptides that may exist and occur from one organism to another. Also, degree and location of glycosylation or other post-translation modifications may vary depending on the chosen host and the nature of the host's cellular environment. The term "IL-10 polypeptide" is also intended to encompass IL-10 polypeptides in their precursor form, as well as those that have been processed to yield their respective bioactive forms. It further encompasses IL-10 polypeptides that have either been chemically modified relative to a reference or naturally-occurring IL-10 polypeptide and/or contain one or more amino acid sequence alterations relative to a reference or naturally-occurring IL-10 polypeptide and/or contain truncated amino acid sequences relative to a reference or naturally-occurring full-length or precursor IL-10 polypeptide. These truncated sequences are typically biologically active fragments of a reference or naturally occurring full-length or precursor IL-10 polypeptide. IL-10 polypeptides may exhibit different properties relative to a reference or naturally-occurring IL-10 polypeptide, including stability and an altered specific activity selected from stimulating or otherwise inducing apoptosis of an adipose cell or tissue; reducing fasting hyperinsulinemia, reducing glucose levels after a hyperglycemic stimulus; reducing hyperinsulinemia after a hyperglycemic stimulus, enhancing peripheral response to insulin; reducing increased adiposity in response to high fat diet, improving mitochondrial fatty acid oxidative capacity of muscle tissue, reducing circulating levels of IL-6, and the like. The term "IL-10 polypeptide" also encompasses proteinaceous molecules with a slightly modified amino acid sequence, for instance, polypeptides having a modified N-terminal end including N-terminal amino acid deletions or additions, and/or polypeptides that have been chemically modified relative to a reference or naturally-occurring IL-10 polypeptide. IL-10 polypeptides also encompass proteinaceous molecules exhibiting substantially the same or better bioactivity than a reference or naturally occurring IL-10 polypeptide, or, alternatively, exhibiting substantially modified or reduced bioactivity relative to a reference or naturally-occurring IL-10 polypeptide. They also include, without limitation, polypeptides having an amino acid sequence that differs from the sequence of a reference or naturally-occurring IL-10 polypeptide by insertion, deletion, or substitution of one or more amino acids and in illustrative examples, encompass proteinaceous molecules that exhibit at least about 10%, 20%, 30%, 40%, 50%, 60%, 70%, 80%, 90%, 100%, 110%, 120%, and 130% of the specific activity of a reference or naturally occurring IL-10 polypeptide that has been produced in the same cell. IL-10 polypeptides having substantially the same or improved biological activity relative to a reference or naturally-occurring IL-10 polypeptide, encompass molecules that exhibit at least about 10%, 20%, 30%, 40%, 50%, 60%, 70%, 80%, 90%, 100%, 110%, 120%, and 130% of the specific biological activity of the reference or naturally-occurring IL-10 polypeptide that has been produced in the same cell type.

The term "IL-22 polypeptide," as used herein encompasses, without limitation, polypeptides having an amino acid sequence that shares at least 70% (and at least 71% to at least 99% and all integer percentages in between) sequence identity or similarity with the sequence set forth in any one of SEQ ID NO: 1. It further encompasses natural allelic variation of IL-22 polypeptides that may exist and occur from one organism to another. Also, degree and location of glycosylation or other post-translation modifications may vary depending on the chosen host and the nature of the host's cellular environment. The term "IL-22 polypeptide" is also intended to encompass IL-22 polypeptides in their precursor form, as well as those that have been processed to yield their respective bioactive forms. It further encompasses IL-22 polypeptides that have either been chemically modified relative to a reference or naturally-occurring IL-22 polypeptide and/or contain one or more amino acid sequence alterations relative to a reference or naturally-occurring IL-22 polypeptide and/or contain truncated amino acid sequences relative to a reference or naturally-occurring full-length or precursor IL-22 polypeptide. These truncated sequences are typically biologically active fragments of a reference or naturally occurring full-length or precursor IL-22 polypeptide. IL-22 polypeptides may exhibit different properties relative to a reference or naturally-occurring IL-22 polypeptide, including stability and an altered specific activity selected from stimulating or otherwise inducing apoptosis of an adipose cell or tissue; reducing fasting hyperinsulinemia, reducing glucose levels after a hyperglycemic stimulus; reducing hyperinsulinemia after a hyperglycemic stimulus, enhancing peripheral response to insulin; reducing increased adiposity in response to high fat diet, improving mitochondrial fatty acid oxidative capacity of muscle tissue, reducing circulating levels of IL-6, and the like. The term "IL-22 polypeptide" also encompasses proteinaceous molecules with a slightly modified amino acid sequence, for instance, polypeptides having a modified N-terminal end including N-terminal amino acid deletions or additions, and/or polypeptides that have been chemically modified relative to a reference or naturally-occurring IL-22 polypeptide. IL-22 polypeptides also encompass proteinaceous molecules exhibiting substantially the same or better bioactivity than a reference or naturally occurring IL-22 polypeptide, or, alternatively, exhibiting substantially modified or reduced bioactivity relative to a reference or naturally-occurring IL-22 polypeptide. They also include, without limitation, polypeptides having an amino acid sequence that differs from the sequence of a reference or naturally-occurring IL-22 polypeptide by insertion, deletion, or substitution of one or more amino acids and in illustrative examples, encompass proteinaceous molecules that exhibit at least about 10%, 20%, 30%, 40%, 50%, 60%, 70%, 80%, 90%, 100%, 110%, 120%, and 130% of the specific activity of a reference or naturally occurring IL-22 polypeptide that has been produced in the same cell. IL-22 polypeptides having substantially the same or improved biological activity relative to a reference or naturally-occurring IL-22 polypeptide, encompass molecules that exhibit at least about 10%, 20%, 30%, 40%, 50%, 60%, 70%, 80%, 90%, 100%, 110%, 120%, and 130% of the specific biological activity of the reference or naturally-occurring IL-22 polypeptide that has been produced in the same cell type.

The term "insulin resistance" refers to a state in which a normal amount of insulin produces a subnormal biologic response relative to the biological response in a subject that does not have insulin resistance.

"Insulin sensitivity" means the ability of cells to take up glucose in response to insulin action.

By "linker" is meant a molecule or group of molecules (such as a monomer or polymer) that connects two molecules and often serves to place the two molecules in a desirable configuration.

"Metabolic syndrome" means a condition characterized by a clustering of lipid and non-lipid risk factors of metabolic origin. In certain embodiments, metabolic syndrome is identified by the presence of any 3 of the following factors: waist circumference of greater than 102 cm in men or greater than 88 cm in women; serum triglyceride of at least 150 mg/dL; HDL-C less than 40 mg/dL in men or less than 50 mg/dL in women; blood pressure of at least 130/85 mmHg; and fasting glucose of at least 110 mg/dL. These determinants can be readily measured in clinical practice (JAMA, 2001, 285: 2486-2497).

By "modulating" is meant increasing or decreasing, either directly or indirectly, the level or functional activity of a target molecule. For example, an agent may indirectly modulate the level/activity by interacting with a molecule other than the target molecule. In this regard, indirect modulation of a gene encoding a target polypeptide includes within its scope modulation of the expression of a first nucleic acid molecule, wherein an expression product of the first nucleic acid molecule modulates the expression of a nucleic acid molecule encoding the target polypeptide.

"Non-alcoholic fatty liver disease (NAFLD)" means a condition-characterized accumulation of fat in the liver in subjects who consume little to no alcohol. In certain embodiments, NAFLD is related to insulin resistance and the metabolic syndrome.

"Nonalcoholic steatohepatitis (NASH)" means a condition characterized by accumulation of fat in the liver, combined with inflammation±scarring in the liver. In certain embodiments NASH results from a worsening progression of NAFLD.

The term "obesity" as used herein includes conditions where there is an increase in body fat beyond the physical requirement as a result of excess accumulation of adipose tissue in the body. Generally, the term "obesity" refers to an excessively high amount of body fat or adipose tissue in relation to lean body mass. The amount of body fat (or adiposity) includes both the distribution of fat throughout the body and the size of the adipose tissue deposits. Body fat distribution can be estimated by skin-fold measures, waist-to-hip circumference ratios, or techniques such as ultrasound, computed tomography, or magnetic resonance imaging. According to the Center for Disease Control and Prevention, individuals with a body mass index (BMI) of 30 or more are considered obese. The term obesity includes, but is not limited to, the following conditions: adult-onset obesity; alimentary obesity; endogenous or metabolic obesity; endocrine obesity; familial obesity; hyperinsulinar obesity; hyperplastic-hypertrophic obesity; hypogonadal obesity; hypothyroid obesity; lifelong obesity; morbid obesity and exogenous obesity. Similarly, the term "diet-induced obesity" (DIO), is a model created to study obesity and its co-morbidities such as type 2 diabetes, hypertension, hypercholesterolemia, and atherosclerosis. In this model, an animal (mouse, rat, dog, or non-human primate) is fed a high fat and/or high sugar diet for a number of weeks. As a result, it becomes obese, and usually hyperglycemic, and develops impaired glucose tolerance.

By "obtained from" is meant that a sample such as, for example, a polynucleotide extract or polypeptide extract is isolated from, or derived from, a particular source.

The term "oxidative stress" as used herein refers to a cell alteration characterized by an excessive production of reactive oxygen species (ROS) and/or reactive nitrogen species (RNS) and a loss of efficacy of antioxidative defenses leading to pathological states in the cell and causing cell or tissue damage. Examples of such damage include but are not limited to oxidation of lipoproteins; membrane phospholipids; lipid peroxidation; protein damage, including cleavage of amino acid bonds and oxidation of functional groups; nucleic acid strand breaks; nucleic acid base modifications leading to point mutations; inhibition of RNA and protein synthesis; protein cross-linking; impaired maintenance of membrane ion gradients; and depletion of cellular levels of ATP, leading to cellular dysfunction and eventually to disease. The oxidant (oxidizing reagent) can be endogenous or exogenous.

The terms "patient," "subject," "host" or "individual" used interchangeably herein, refer to any subject, particularly a vertebrate subject, and even more particularly a mammalian subject, for whom therapy or prophylaxis is desired. Suitable vertebrate animals that fall within the scope of the invention include, but are not restricted to, any member of the subphylum Chordata including primates (e.g., humans, monkeys and apes, and includes species of monkeys such from the genus *Macaca* (e.g., cynomologus monkeys such as *Macaca fascicularis*, and/or rhesus monkeys (*Macaca mulatta*)) and baboon (*Papio ursinus*), as well as marmosets (species from the genus *Callithrix*), squirrel monkeys (species from the genus *Saimiri*) and tamarins (species from the genus *Saguinus*), as well as species of apes such as chimpanzees (Pan troglodytes)), rodents (e.g., mice rats, guinea pigs), lagomorphs (e.g., rabbits, hares), bovines (e.g., cattle), ovines (e.g., sheep), caprines (e.g., goats), porcines (e.g., pigs), equines (e.g., horses), canines (e.g., dogs), felines (e.g., cats), avians (e.g., chickens, turkeys, ducks, geese, companion birds such as canaries, budgerigars etc.), marine mammals (e.g., dolphins, whales), reptiles (snakes, frogs, lizards etc.), and fish. A preferred subject is a human in need of reducing OER stress in a cell, for example a β-cell (e.g., a human having or at risk of a metabolic disorder). However, it will be understood that the aforementioned terms do not imply that symptoms are present.

"Pre-diabetes" means a condition in which a subject's blood glucose levels are higher than in a subject with normal blood glucose levels and lower but not high enough for a diagnosis of diabetes.

By "pharmaceutically acceptable carrier" is meant a solid or liquid filler, diluent or encapsulating substance that can be safely used in topical or systemic administration to an animal, preferably a mammal, including humans. Representative pharmaceutically acceptable carriers include any and all solvents, dispersion media, coatings, surfactants, antioxidants, preservatives (e.g., antibacterial agents, antifungal agents), isotonic agents, absorption delaying agents, salts, preservatives, drugs, drug stabilizers, gels, binders, excipients, disintegration agents, lubricants, sweetening agents, flavoring agents, dyes, such like materials and combinations thereof, as would be known to one of ordinary skill in the art (see, for example, Remington's Pharmaceutical Sciences, 18th Ed. Mack Printing Company, 1990, pp. 1289-1329, incorporated herein by reference). Except insofar as any conventional carrier is incompatible with the active ingredient(s), its use in the pharmaceutical compositions is contemplated.

The term "polynucleotide" or "nucleic acid" as used herein designates mRNA, RNA, cRNA, cDNA or DNA. The term typically refers to polymeric form of nucleotides of at least 10 bases in length, either ribonucleotides or deoxynucleotides or a modified form of either type of nucleotide. The term includes single and double stranded forms of DNA.

The terms "polynucleotide variant" and "variant" and the like refer to polynucleotides displaying substantial sequence identity with a reference polynucleotide sequence or polynucleotides that hybridize with a reference sequence under stringent conditions that are defined hereinafter. These terms also encompass polynucleotides that are distinguished from a reference polynucleotide by the addition, deletion or substitution of at least one nucleotide. Accordingly, the terms "polynucleotide variant" and "variant" include polynucleotides in which one or more nucleotides have been added or deleted, or replaced with different nucleotides. In this regard, it is well understood in the art that certain alterations inclusive of mutations, additions, deletions and substitutions can be made to a reference polynucleotide whereby the altered polynucleotide retains the biological function or activity of the reference polynucleotide. The terms "polynucleotide variant" and "variant" also include naturally occurring allelic variants.

"Polypeptide," "peptide," "protein" and "proteinaceous molecule" are used interchangeably herein to refer to molecules comprising or consisting of a polymer of amino acid residues and to variants and synthetic analogues of the same. Thus, these terms apply to amino acid polymers in which one or more amino acid residues are synthetic non-naturally occurring amino acids, such as a chemical analogue of a corresponding naturally occurring amino acid, as well as to naturally-occurring amino acid polymers.

The terms "peptide variant" and "polypeptide variant" and the like refer to peptides and polypeptides that are distinguished from a reference peptide or polypeptide by the addition, deletion or substitution of at least one amino acid residue. In certain embodiments, a peptide or polypeptide variant is distinguished from a reference peptide or polypeptide by one or more substitutions, which may be conservative or non-conservative. In certain embodiments, the peptide or polypeptide variant comprises conservative substitutions and, in this regard, it is well understood in the art that some amino acids may be changed to others with broadly similar properties without changing the nature of the activity of the peptide or polypeptide. Peptide and polypeptide variants also encompass peptides and polypeptides in which one or more amino acids have been added or deleted, or replaced with different amino acid residues.

By "recombinant polypeptide" is meant a polypeptide made using recombinant techniques, i.e., through the expression of a recombinant polynucleotide.

The term "sequence identity" as used herein refers to the extent that sequences are identical on a nucleotide-by-nucleotide basis or an amino acid-by-amino acid basis over a window of comparison. Thus, a "percentage of sequence identity" is calculated by comparing two optimally aligned sequences over the window of comparison, determining the number of positions at which the identical nucleic acid base (e.g., A, T, C, G, I) or the identical amino acid residue (e.g., Ala, Pro, Ser, Thr, Gly, Val, Leu, Ile, Phe, Tyr, Trp, Lys, Arg, His, Asp, Glu, Asn, Gln, Cys and Met) occurs in both sequences to yield the number of matched positions, dividing the number of matched positions by the total number of positions in the window of comparison (i.e., the window size), and multiplying the result by 100 to yield the percentage of sequence identity. The present invention contemplates the use in the methods and systems of the present invention of full-length IL-22 polypeptides as well as their biologically active fragments. Typically, biologically active fragments of a full-length IL-22 polypeptide may participate in an interaction, for example, an intra-molecular or an inter-molecular interaction.

"Similarity" refers to the percentage number of amino acids that are identical or constitute conservative substitutions as defined in Tables 1 and 2 supra. Similarity may be determined using sequence comparison programs such as GAP (Deveraux et al. 1984, *Nucleic Acids Research* 12: 387-395). In this way, sequences of a similar or substantially different length to those cited herein might be compared by insertion of gaps into the alignment, such gaps being determined, for example, by the comparison algorithm used by GAP.

Terms used to describe sequence relationships between two or more polynucleotides or polypeptides include "reference sequence," "comparison window", "sequence identity," "percentage of sequence identity" and "substantial identity". A "reference sequence" is at least 12 but frequently 15 to 18 and often at least 25 monomer units, inclusive of nucleotides and amino acid residues, in length. Because two polynucleotides may each comprise (1) a sequence (i.e., only a portion of the complete polynucleotide sequence) that is similar between the two polynucleotides, and (2) a sequence that is divergent between the two polynucleotides, sequence comparisons between two (or more) polynucleotides are typically performed by comparing sequences of the two polynucleotides over a "comparison window" to identify and compare local regions of sequence similarity. A "comparison window" refers to a conceptual segment of at least 6 contiguous positions, usually about 50 to about 100, more usually about 100 to about 150 in which a sequence is compared to a reference sequence of the same number of contiguous positions after the two sequences are optimally aligned. The comparison window may comprise additions or deletions (i.e., gaps) of about 20% or less as compared to the reference sequence (which does not comprise additions or deletions) for optimal alignment of the two sequences. Optimal alignment of sequences for aligning a comparison window may be conducted by computerized implementations of algorithms (GAP, BESTFIT, FASTA, and TFASTA in the Wisconsin Genetics Software Package Release 7.0, Genetics Computer Group, 575 Science Drive Madison, Wis., USA) or by inspection and the best alignment (i.e., resulting in the highest percentage homology over the comparison window) generated by any of the various methods selected. Reference also may be made to the BLAST family of programs as for example disclosed by Altschul et al., 1997, *Nucl. Acids Res.* 25:3389. A detailed discussion of sequence analysis can be found in Unit 19.3 of Ausubel et al., "Current Protocols in Molecular Biology", John Wiley & Sons Inc, 1994-1998, Chapter 15.

"Stringency" as used herein, refers to the temperature and ionic strength conditions, and presence or absence of certain organic solvents, during hybridization and washing procedures. The higher the stringency, the higher the degree of complementarity will be between immobilized target nucleotide sequences and probe nucleotide sequences that remain hybridized to the target after washing. Stringency conditions include low, medium, high and very high stringency conditions, which describe certain conditions for hybridization and washing. Guidance for performing hybridization reactions can be found in Ausubel et al., (1998, supra), Sections 6.3.1-6.3.6. Aqueous and non-aqueous methods are described in that reference and either can be used. Reference herein to low stringency conditions include and encompass from at least about 1% v/v to at least about 15% v/v formamide and from at least about 1 M to at least about 2 M salt for hybridization at 42° C., and at least about 1 M to at least about 2 M salt for washing at 42° C. Low stringency conditions also may include 1% Bovine Serum Albumin (BSA), 1 mM EDTA, 0.5 M NaHPO$_4$ (pH 7.2), 7% SDS for hybridization at 65° C., and (i) 2×SSC, 0.1% SDS; or (ii) 0.5% BSA, 1 mM EDTA, 40 mM NaHPO$_4$ (pH 7.2), 5% SDS for washing at room temperature. One embodiment of low stringency conditions includes hybridization in 6× sodium chloride/sodium citrate (SSC) at about 45° C., followed by two washes in 0.2×SSC, 0.1% SDS at least at 50° C. (the temperature of the washes can be increased to 55° C. for low stringency conditions). Medium stringency conditions include and encompass from at least about 16% v/v to at least about 30% v/v formamide and from at least about 0.5 M to at least about 0.9 M salt for hybridization at 42° C., and at least about 0.1 M to at least about 0.2 M salt for washing at 55° C. Medium stringency conditions also may include 1% Bovine Serum Albumin (BSA), 1 mM EDTA, 0.5 M NaHPO$_4$ (pH 7.2), 7% SDS for hybridization at 65° C., and (i) 2×SSC, 0.1% SDS; or (ii) 0.5% BSA, 1 mM EDTA, 40 mM NaHPO$_4$ (pH 7.2), 5% SDS for washing at 60-65° C. One embodiment of medium stringency conditions includes hybridizing in 6×SSC at about 45° C., followed by one or more washes in 0.2×SSC, 0.1% SDS at 60° C. High stringency conditions include and encompass from at least about 31% v/v to at least about 50% v/v formamide and from about 0.01 M to about 0.15 M salt for hybridization at 42° C., and about 0.01 M to about 0.02 M salt for washing at 55° C. High stringency conditions also may include 1% BSA, 1 mM EDTA, 0.5 M NaHPO$_4$ (pH 7.2), 7% SDS for hybridization at 65° C., and (i) 0.2×SSC, 0.1% SDS; or (ii) 0.5% BSA, 1 mM EDTA, 40 mM NaHPO$_4$ (pH 7.2), 1% SDS for washing at a temperature in excess of 65° C. One embodiment of high stringency conditions includes hybridizing in 6×SSC at about 45° C., followed by one or more washes in 0.2×SSC, 0.1% SDS at 65° C. In certain embodiments, a peptide or polypeptide is encoded by a polynucleotide that hybridizes to a reference nucleotide sequence under very high stringency conditions. One embodiment of very high stringency conditions includes hybridizing 0.5 M sodium phosphate, 7% SDS at 65° C., followed by one or more washes at 0.2×SSC, 1% SDS at 65° C. Other stringency conditions are well known in the art and a skilled addressee will recognize that various factors can be manipulated to optimize the specificity of the hybridization. Optimization of the stringency of the final washes can serve to ensure a high degree of hybridization. For detailed examples, see Ausubel et al., supra at pages 2.10.1 to 2.10.16 and Sambrook et al. (1989, supra) at sections 1.101 to 1.104. While stringent washes are typically carried out at temperatures from about 42° C. to 68° C., one skilled in the art will appreciate that other temperatures may be suitable for stringent conditions. Maximum hybridization rate typically occurs at about 20° C. to 25° C. below the T$_m$ for formation of a DNA-DNA hybrid. It is well known in the art that the T$_m$ is the melting temperature, or temperature at which two complementary polynucleotide sequences dissociate. Methods for estimating T$_m$ are well known in the art (see Ausubel et al., supra at page 2.10.8). In general, the T$_m$ of a perfectly matched duplex of DNA may be predicted as an approximation by the formula:

$$T_m=81.5+16.6(\log_{10} M)+0.41(\% \, G+C)-0.63(\% \, \text{formamide})-(600/\text{length})$$

wherein: M is the concentration of Na$^+$, preferably in the range of 0.01 molar to 0.4 molar; % G+C is the sum of guanosine and cytosine bases as a percentage of the total number of bases, within the range between 30% and 75% G+C; % formamide is the percent formamide concentration by volume; length is the number of base pairs in the DNA duplex. The T$_m$ of a duplex DNA decreases by approximately 1° C. with every increase of 1% in the number of randomly mismatched base pairs. Washing is generally carried out at T$_m$–15° C. for high stringency, or T$_m$–30° C. for moderate stringency. In one example of a hybridization procedure, a membrane (e.g., a nitrocellulose membrane or a nylon membrane) containing immobilized DNA is hybridized overnight at 42° C. in a hybridization buffer (50% deionized formamide, 5×SSC, 5×Denhardt's solution (0.1% ficoll, 0.1% polyvinylpyrrolidone and 0.1% bovine serum albumin), 0.1% SDS and 200 mg/mL denatured salmon sperm DNA) containing labeled probe. The membrane is then subjected to two sequential medium stringency washes (i.e., 2×SSC, 0.1% SDS for 15 min at 45° C., followed by 2×SSC, 0.1% SDS for 15 min at 50° C.), followed by two sequential higher stringency washes (i.e., 0.2×SSC, 0.1% SDS for 12 min at 55° C. followed by 0.2×SSC and 0.1% SDS solution for 12 min at 65-68° C.

"Steatosis" means a condition characterized by the excessive accumulation of triglycerides in hepatocytes.

"Steatohepatitis" means steatosis with inflammation.

The term "sulfonylurea compound" and grammatical variations thereof, includes the stereoisomers of the compound, pharmaceutically acceptable salts of the compound, prodrugs of the compound, and pharmaceutically acceptable salts of the prodrugs.

As used herein, the term "therapeutic agent" refers to an agent comprising the specified elements, as well as any agent that results, directly or indirectly, from the combination of the specified elements.

As used herein, the terms "treatment", "treating", and the like, refer to obtaining a desired pharmacologic and/or physiologic effect. The effect may be prophylactic in terms of completely or partially preventing a disease or symptom thereof and/or may be therapeutic in terms of a partial or complete cure for a disease and/or adverse affect attributable to the disease. "Treatment", as used herein, covers any treatment of a disease in a mammal, particularly in a human, and includes: (a) preventing the disease from occurring in a subject which may be predisposed to the disease but has not yet been diagnosed as having it; (b) inhibiting the disease, i.e., arresting its development; and (c) relieving the disease, i.e., causing regression of the disease.

The term "type 1 diabetes" is defined as the condition in which a subject has, in the presence of autoimmunity towards the pancreatic β-cell or insulin, a fasting blood glucose or serum glucose concentration greater than 125 mg/dL (6.94 mmol/L). The presence of autoimmunity towards the pancreatic β-cell may be observed by detection of circulating islet cell autoantibodies ["type IA diabetes mellitus"], i.e., at least one of: GAD65 [glutamic acid decarboxylase-65], ICA [islet-cell cytoplasm], IA-2 [intracytoplasmic domain of the tyrosine phosphatase-like protein IA-2], ZnT8 [zinc-transporter-8] or anti-insulin; or other signs of autoimmunity without the presence of typical circulating autoantibodies [type IB diabetes], i.e., as detected through pancreatic biopsy or imaging). Typically a genetic predisposition is present (e.g. HLA, INS VNTR and PTPN22), but this is not always the case.

"Type 2 diabetes" or "non-insulin dependent diabetes mellitus" refers to an insulin-related disorder in which there is a relative disparity between endogenous insulin production and insulin requirements, leading to elevated hepatic glucose production, elevated blood glucose levels, inappropriate insulin secretion, and peripheral insulin resistance. Type 2 diabetes has been regarded as a relatively distinct disease entity, but type 2 diabetes is often a manifestation of a much broader underlying disorder (Zimmet et al., 2001 *Nature* 414: 782-787), which may include metabolic syndrome (syndrome X), diabetes (e.g., type 2 diabetes, type 2 diabetes, gestational diabetes, autoimmune diabetes), hyperinsulinemia, hyperglycemia, impaired glucose tolerance (IGT), hypoglycemia, β-cell failure, insulin resistance, dyslipidemias, atheroma, insulinoma, hypertension, hypercoagulability, microalbuminuria, and obesity and other adiposity-related conditions such as visceral obesity, central fat, obesity-related type 2 diabetes, obesity-related atherosclerosis, heart disease, obesity-related insulin resistance, obesity-related hypertension, microangiopathic lesions resulting from obesity-related type 2 diabetes, ocular lesions caused by microangiopathy in obese individuals with obesity-related type U diabetes, and renal lesions caused by microangiopathy in obese individuals with obesity-related type 2 diabetes.

The terms "wild-type" and "naturally occurring" are used interchangeably to refer to a gene or gene product that has the characteristics of that gene or gene product when isolated from a naturally occurring source. A wild type gene or gene product (e.g., a polypeptide) is that which is most frequently observed in a population and is thus arbitrarily designed the "normal" or "wild-type" form of the gene.

As used herein, underscoring or italicizing the name of a gene shall indicate the gene, in contrast to its protein product, which is indicated by the name of the gene in the absence of any underscoring or italicizing. For example, "IL-22" shall mean the IL-22 gene or IL-22 polynucleotides, whereas "IL-22" shall indicate the protein product or products generated from transcription and translation and alternative splicing of the "IL-22" gene.

Each embodiment described herein is to be applied mutatis mutandis to each and every embodiment unless specifically stated otherwise.

2. OER Stress Inhibitors 2.1 Cytokines that Inhibit or Reduce OER Stress

The present invention provides therapeutic agents that inhibit, reduce or normalize OER stress in a β-cell, and is based in part on the determination that some cytokines produced in the local environment in the pancreatic islets, such as IL-23 and IL-24 promote or induce β-cell OER stress, whilst others such as IL-22 actively inhibit or reduce it. Furthermore, in obesity high concentrations of lipids and glucose, and high rates of insulin biosynthesis required due to insulin resistance, contribute to OER stress in β-cells. Thus, the present inventors consider that β-cell OER stress inhibitors will be useful in the treatment of diseases associated with aberrant β-cell ER stress, including metabolic disorders such as diabetes.

The present invention contemplates the use of any molecule that inhibits or reduces OER stress in a β-cell. In accordance with the present invention, the OER stress inhibitor is suitably selected from an IL-22 polypeptide, an IL-10 polypeptide or an antagonist of any one of IL-23, IL-24, IL-33, IL-1β, MIP-2α, IL-17A, IFN-γ or IFN-β.

In preferred embodiments, the OER stress inhibitor is an IL-22 polypeptide. The present inventors have discovered that IL-22 is a powerful endogenous paracrine suppressor of OER stress in pancreatic islets, and that in obesity-induced hyperglycemia IL-22 therapy restores glucose control by attenuating defects in pancreatic insulin biosynthesis and secretion. IL-22 reduces OER stress in pancreatic β-cells. Notably, IL-22 reduces stress induced by lipids, inflammatory cytokines or environmental ROS, e.g., via STAT1- and STAT3-mediated upregulation of anti-oxidant genes and suppression of oxidative stress-inducing genes.

Accordingly, in some embodiments the OER stress inhibitor is an IL-22 polypeptide comprising, consisting or consisting essentially of an amino acid sequence selected from:
(a) an amino acid sequence selected from: MAALQKSVSSFLM GTLATSCLLLLALLVQGGAAAPISSHCRLDKSNFQQPYITNRTFMLA KEASLADNNTDVRLIGEKLFHGVSMSERCYLMKQVLNFTLEEVLFPQSDRFQPYMQEVVP FLARLSNRLSTCHIEGDDLHIQRNVQKLKDTVKKLGESGEIKAIGELDLLFMSLRNACI [SEQ ID NO: 2], which corresponds to the amino acid sequence of the precursor form of IL-22, or APISSHCRLDKSNFQQPYITNRTFMLAKEASLADNNTDVRLIGEKLFHGVSMSERCYLMKQVLNF TLEEVLFPQSDRFQPYMQEVVPFLARLSNRLSTCHIEGDDLHIQRNVQKLKDTVKKLGESGEIKAI GELDLLFMSLRNACI [SEQ ID NO: 4], which corresponds to the amino acid sequence of the mature form of IL-22; or
(b) an amino acid sequence that shares at least 70% (and at least 71% to at least 99% and all integer percentages in between) sequence similarity or sequence identity with the sequence set forth in any one of SEQ ID NO: 2 or 4; or
(c) an amino acid sequence that is encoded by a nucleotide sequence selected from: atggccgccctgcagaaatcgtgagctctttccttatggggaccctggccaccagctgcctcctctcttggc-
cctcttggta cagggaggagcagctgcgcccatcagctcccactgcag-
gcttgacaagtccaacttccagcagccctatatcaccaaccg
caccttcatgctggctaaggaggctagcttggctgataacaacacagacgt-
tcgtctcattggggagaaactgttccacgg agtcagtatgagtgagcgct-
gctatctgatgaagcaggtgctgaacttcacccttgaagaagtgctgttc-
cctcaatctgat
aggttccagccttatatgcaggaggtggtgcccttcctggccaggctcag-
caacaggctaagcacatgtcatattgaaggt gatgacctgcatatcca-
gaggaatgtgcaaaagctgaaggacacagtgaaaaagcttggaga-
gagtggagagatcaa
agcaattggagaactggatttgctgtttatgtctctgagaaatgcctgcatt [SEQ ID NO: 1], which corresponds to the coding sequence for the amino acid sequence set forth in SEQ ID NO: 2, or
gcgcccatcagctcccactgcaggcttgacaagtccaacttccagcagc-
cctatatcaccaaccgcaccttcatgctg gctaaggaggctagcttggct-
gataacaacacagacgttcgtctcattggggagaaactgttccacg-
gagtcagtatgag
tgagcgctgctatctgatgaagcaggtgctgaacttcacccttgaagaagt-
gctgttccctcaatctgataggttccagcctt atatgcaggaggtggtgc-
ccttcctggccaggctcagcaacaggctaagcacatgtcatattgaaggt-
gatgacctgcata
tccagaggaatgtgcaaaagctgaaggacacagtgaaaaagcttggaga-
gagtggagagatcaaagcaattggagaa ctggatttgctgtttatgtctct-
gagaaatgcctgcatt [SEQ ID NO: 3], which corresponds to the coding sequence for the amino acid sequence set forth in SEQ ID NO: 4;

(d) an amino acid sequence that is encoded by a nucleotide sequence that shares at least 70% (and at least 71% to at least 99% and all integer percentages in between) sequence identity with the sequence set forth in SEQ ID NO: 1 or 3, or a complement thereof; or (e) an amino acid sequence that is encoded by a nucleotide sequence that hybridizes under low, medium or high stringency conditions to the sequence set forth in any one of SEQ ID NO: 1 or 3, or a complement thereof, wherein the amino acid sequence of (a), (b), (c), (d) or (e) has any one or more activities selected from: improving pancreatic β-cell ER function, improving insulin biosynthesis, increasing glucose tolerance, modulating expression of oxidative stress regulatory genes, reducing stress induced by lipids, glucose, inflammatory cytokines or environmental ROS, e.g., via STAT1- and STAT3-mediated upregulation of anti-oxidant genes and suppression of oxidative stress-inducing genes, reducing ER stress, promoting secretion of high quality efficacious insulin, restoring glucose homeostasis or enhancing peripheral insulin sensitivity.

In other embodiments, the OER stress inhibitor is an IL-10 polypeptide comprising, consisting or consisting essentially of an amino acid sequence selected from:

(a) an amino acid sequence selected from: MHSSALLC-CLVLLTGVRASPGQGTQSENSCTHFPGNLPNML-RDLRDAFSRVKTFFQMKDQLDNL LLKESLLED-FKGYLGCQALSEMIQFYLEEVMPQAENQDP-DIKAHVNSLGENLKTLRLRLRRCHRFL PCENKSKAVEQVKNAFNKLQEKGIYKAMSEFDI-FINYIEAYMTMKIRN [SEQ ID NO: 6], which corresponds to the amino acid sequence of the precursor form of IL-10, or
SPGQGTQSENSCTHFPGNLPNMLRDLRDAFSRVK-TFFQMKDQLDNLLLKESLLEDFKGYL GCQALSEMIQFYLEEVMPQAENQDP-DIKAHVNSLGENLKTLRLRLRRCHRFLPCENK-SKA VEQVKNAFNKLQEKGIYKAMSEFDI-FINYIEAYMTMKIRN [SEQ ID NO:8], which corresponds to the amino acid sequence of the mature form of IL-10.

(b) an amino acid sequence that shares at least 70% (and at least 71% to at least 99% and all integer percentages in between) sequence similarity or sequence identity with the sequence set forth in any one of SEQ ID NO: 6 or 8; or (c) an amino acid sequence that is encoded by a nucleotide sequence selected from: atgcacagctcagcactgctctgttgc-ctggtcctcctgactggggtgagggccagcccaggccagggcaccca-gtctga gaacagctgcacccacttcccaggcaacctgcctaacatgcttc-gagatctccgagatgccttcagcagagtgaagacttt ctttcaaatgaaggatcagctggacaacttgttgttaaaggagtccttgctg-gaggactttaagggttacctgggttgccaa gccttgtctgagatgatcca-gttttacctggaggaggtgatgccccaagctgagaaccaagacccaga-catcaaggcgca tgtgaactccctgggggagaacctgaagaccctcaggctgaggctacg-gcgctgtcatcgatttcttccctgtgaaaacaa gagcaaggccgtg-gagcaggtgaagaatgcctttaataagctccaagagaaaggcatcta-caaagccatgagtgagttt gacatcttcatcaactacatagaagcctacatgacaatgaagatacgaaac [SEQ ID NO: 5], which corresponds to the coding sequence for the amino acid sequence set forth in SEQ ID NO: 6, or agcccaggccagggcacccagtctgagaacagctgcacccacttccag-gcaacctgcctaacatgcttcgagatc tccgagatgccttcagcagagt-gaagactttctttcaaatgaaggatcagctggacaacttgttgt-taaaggagtccttgct ggaggactttaagggttacctgggttgccaagccttgtctgagatgatcca-gttttacctggaggaggtgatgccccaagc tgagaaccaagacccaga-catcaaggcgcatgtgaactccctgggggagaacctgaagaccctcag-gctgaggctacg gcgctgtcatcgatttcttccctgtgaaaacaagagcaaggccgtggagca-ggtgaagaatgcctttaataagctccaag agaaaggcatctacaaagc-catgagtgagtttgacatcttcatcaactacatagaagcctacatgacaat-gaagatacga aac [SEQ ID NO: 7], which corresponds to the coding sequence for the amino acid sequence set forth in SEQ ID NO: 8;

(d) an amino acid sequence that is encoded by a nucleotide sequence that shares at least 70% (and at least 71% to at least 99% and all integer percentages in between) sequence identity with the sequence set forth in SEQ ID NO: 5 or 7, or a complement thereof; or (e) an amino acid sequence that is encoded by a nucleotide sequence that hybridizes under low, medium or high stringency conditions to the sequence set forth in any one of SEQ ID NO: 5 or 7, or a complement thereof, wherein the amino acid sequence of (a), (b), (c), (d) or (e) has any one or more activities selected from: improving pancreatic β-cell ER function, improving insulin biosynthesis, increasing glucose tolerance, modulating expression of oxidative stress regulatory genes, reducing stress induced by lipids, glucose, inflammatory cytokines or environmental ROS, e.g., via STAT1- and STAT3-mediated upregulation of anti-oxidant genes and suppression of oxidative stress-inducing genes, reducing ER stress, promoting secretion of high quality efficacious insulin, restoring glucose homeostasis or enhancing peripheral insulin sensitivity.

In some embodiments, the IL-22 or IL-10 polypeptide is a biologically active fragment of a full-length IL-22 or IL-10 polypeptide, (i.e., one that includes less amino acids than the full-length IL-22 or IL-10 polypeptide as set forth for example in SEQ ID NO: 2, 4, 6 or 8), and exhibits at least one activity selected from: improving pancreatic ER function, improving insulin biosynthesis, increasing glucose tolerance, inhibiting expression of oxidative stress regulatory genes, reducing stress induced by lipids, inflammatory cytokines or environmental ROS, e.g., via STAT1- and STAT3-mediated upregulation of anti-oxidant genes and suppression of oxidative stress-inducing genes, reducing ER stress, promoting secretion of high quality efficacious insulin, restoring glucose homeostasis or enhancing peripheral insulin sensitivity. In specific embodiments, the biologically active fragment comprises 1, 2, 3, 4, 5, 6, 7, 8, 9, 10, 11, 12, 13, 14, 15, 16, 17, 18, 19, 20, 25, 30, 35, 40, 45, 50 fewer residues at one or both ends (i.e., N-terminus and/or C-terminus) relative to the amino acid sequence of the full-length polypeptide. In illustrative examples of this type, the biologically active fragment comprises about 10 to about 145 amino acid residues (and all integer amino acid residues in between).

2.2 Antagonists of OER Stress Inducers

The present inventors have found that IL-24, IL-23 and IL-33 are potent inducers of β-cell OER stress and that IL-1β, MIP-2α, IL-17A, IFN-γ and IFN-β cause milder OER stress in a β-cell. Accordingly, it is proposed that agents that inhibit or reduce the level or antagonize the function of any one or more of these cytokines will reduce OER stress in a β-cell. Illustrative examples of OER stress inhibitors of this type include antigen-binding molecules that are immuno-interactive with an OER-stress inducing cytokine selected from the group consisting of IL-24, IL-23, IL-33, IL-1β, MIP-2α, IL-17A, IFN-γ and IFN-8, or soluble receptors that bind these cytokines.

In specific embodiments, the OER stress inhibitor is an antigen-binding molecule that is immuno-interactive with IL-24 (also known as melanoma differentiation associated-7, or MDA-7). Antigen-binding molecules of this type are commercially available for example from Santa Cruz Biotechnology (Santa Cruz, Calif.), LifeSpan Biosciences (Seattle, Wash.) and Proteintech Group (Chicago, Ill.).

In other embodiments, the OER stress inhibitor is a soluble receptor that binds to IL-24, representative examples of which are disclosed in U.S. Pat. No. 7,855,269, which is hereby incorporated by reference herein in its entirety. Suitably, the soluble receptor comprises an extracellular domain of IL-20RA and an extracellular domain of IL-20RB and in illustrative examples of this type, the extracellular domain of IL-20RA comprises, consists or consists essentially of the amino acid sequence: VPCVSGGLPKPANIT-FLSINMKNVLQWTPPEGLQGVKVTYTVQYFIYGQK-KWLNKSECRNINRTYCD LSAETSDYEHQYYAKVKAIWGTKCSKWAESGRFYP-FLETQIGPPEVALTTDEKSISVVLTAPEKWKR NPEDLPVSMQQIYSNLKYNVSVLNTKSN-RTWSQCVTNHTLVLTWLEPNTLYCVHVESFVPGP-PRRAQ PSEKQCARTLKDQSSEFKAK [SEQ ID NO: 196], and wherein the extracellular domain of IL-20RB comprises, consists or consists essentially of the amino acid sequence: DEVAILPAPQNLSVLSTNMKHLLMWSPVI-APGETVYYSVEYQGEYESLYTSHIWIPSSWCSLTEG-PEC DVTDDITATVPYNLRVRATLGSQTSAWSILKHPF-NRNSTILTRPGMEITKDGFHLVIELEDLGPQFEFL VAYWRREPGAEEHVKMVRSGGIPVHLETMEPGAAY-CVKAQTFVKAIGRYSAFSQTECVEVQGEAIP [SEQ ID NO: 197]. In some embodiments, the soluble receptor comprises (1) an extracellular domain of IL-20RA fused to the heavy chain of IgGγ1, which comprises, consists or consists essentially of the sequence: VPCVSGGLPKPANITFLSIN-MKNVLQWTPPEGLQGVKVTYTVQYFIYGQK-KWLNKSECRNINRTYCD LSAETSDYEHQYYAK-VKAIWGTKCSKWAESGRFYPFLETQIGPPEVALTT-DEKSISVVLTAPEKWKR NPEDLPVSMQQIYSNLKYNVSVLNTKSN-RTWSQCVTNHTLVLTWLEPNTLYCVHVESFVPGP-PRRAQ PSEKQCARTLKDQSSEASTKGPSVF-PLAPSSKSTSGGTAALGCLVKDYFPEPVTVSWNSG-ALTSGVH TFPAVLQSSGLYSLSSVVTVPSSSLGTQTYICNVNH-KPSNTKVDKKVEPKSCDKTHTCPPCPAPELLG GPSV-FLFPPKPKDTLMISRTPEVTCVVVDVSHEDPEVKFN-WYVDGVEVHNAKTKPREEQYNSTYRVV SVLTVLHQDWLNGKEYKCKVSNKALPAPIEK-TISKAKGQPREPQVYTLPPSRDELTKNQVSLTCLVKG FYPSDIAVEWESNGQPENNYKTTPPVLDSDGSFFLY-SKLTVDKSRWQQGNVFSCSVMHEALHNHYT QKSLSLSPGK [SEQ ID NO: 198], and (2) an extracellular domain of IL-20RB fused to the human κ light chain, which comprises, consists or consists essentially of the sequence: DEVAILPAPQNLSVLSTNMKHLLMWSPVIAPGET-VYYSVEYQGEYESLYTSHIWIPSSWCSLTEGPEC DVTDDITATVPYNLRVRATLGSQTSAWSILKHPFNRN-STILTRPGMEITKDGFHLVIELEDLGPQFEFL VAYWR-REPGAEEHVKMVRSGGIPVHLETMEPGAAY-CVKAQTFVKAIGRYSAFSQTECVEVQGEATV AAPSVFIFPPSDEQLKSGTASVVCLLNNFYPREAK-VQWKVDNALQSGNSQESVTEQDSKDSTYSLS STLTLSKADYEKHKVYACEVTHQGLSSPVTKSFN-RGEC [SEQ ID NO: 199]. In these embodiments, polypeptides (1) and (2) come together and a disulfide bond is formed between the heavy and the light chains to form a heterodimer.

In still other embodiments, the OER stress inhibitor is an antigen-binding molecule that is immuno-interactive with IL-23. Numerous antigen-binding molecules of this type are known, illustrative examples of which include the anti-human IL-23 antigen-binding proteins disclosed in U.S. Pat. Appl. No. 2013/0004501, which is incorporated by reference herein in its entirety. Exemplary antigen-binding proteins comprise a heavy chain variable region comprising complementarity determining regions CDRH1, CDRH2, CDRH3 and a light chain variable region comprising complementarity determining regions CDRL1, CDRL2, CDRL3 as defined in Table 3 of U.S. 2013/0004501. In one embodiment, the antigen-binding protein comprises a heavy chain variable domain of SEQ ID NO: 200 (QVQLVES-GGGVVQPGRSLRLSCAASGFTFSSYGMHWVRQAPG-KGLEWVAVIWYDGSNEYYADSV KGRFTISRDN-SKNTLYLQMNSLRAEDTAVYYCARDRGYTSSWYP-DAFDIWGQGTMVTVSS), and a light chain variable domain of SEQ ID NO: 201 (QSVLTQPPSVS-GAPGQRVTISCTGSSSNTGAGYDVHWYQQVPGTAP-KLLIYGSGNRPSGVPDRFS GSKSGTSASLAITGLQAE-DEADYYCQSYDSSLSGWVFGGGTRLTVL). A non-limiting example of this type is a single chain antibody that comprises the sequence: QSVLTQPPSVS-GAPGQRVTISCTGSSSNTGAGYDVHWYQQVPGTAP-KLLIYGSGNRPSGVPDRFSG SKSGTSASLAITGLQAE-DEADYYCQSYDSSLSGWVFGGGTRLTVLGGGGS-GGGGSGGGGSQVQL VESGGGVVQPGRSLRLSCAASGFTFSSYGMH-WVRQAPGKGLEWVAVIWYDGSNEYYADSVKGRFT ISRDNSKNTLYLQMNSLRAEDTAVYYCARDRGYTSS-WYPDAFDIWGQGTMVTVSS [SEQ ID NO; 202].

In other embodiments, the OER stress inhibitor is an antigen-binding molecule that is immuno-interactive with IL-23R. Several antigen-binding molecules of this type are known, illustrative examples of which include the anti-human IL-23R binding compounds disclosed in U.S. Pat. No. 8,309,085, which is incorporated by reference herein in its entirety. Representative compounds of this type comprise: a) an antibody light chain variable domain, or antigen binding fragment thereof, comprising CDRL1, CDRL2 and CDRL3, wherein: CDRL1 comprises the sequence of SEQ ID NO: 203 (LASEDIYNNLA); CDRL2 comprises the sequence of SEQ ID NO: 204 (HASSLQD); and CDRL3 comprises the sequence of SEQ ID NO: 205 (LQD-SEYPPT); and b) an antibody heavy chain variable domain, or antigen binding fragment thereof, comprising CDRH1, CDRH2 and CDRH3, wherein: CDRH1 comprises the sequence of SEQ ID NO: 206 (GFDFNSYGMS); CDRH2 comprises the sequence of SEQ ID NO: 207 (DINSKSYN-YATYYADSVKD); and CDRH3 comprises the sequence of SEQ ID NO: 208 (HHSDYFEY). In illustrative examples of this type, the anti-human IL-23R binding compound comprises a) an antibody light chain variable domain comprising the sequence of SEQ ID NO: 209 (DIQMTQSPSSLSAS-VGDRVTITCLASEDIYNNLAWYQQKPGKAPKLLI-YHASSLQDGVPSRFSGSG SGTDFTLTISSLQPEDFA-TYYCLQDSEYPPTFGQGTKVEIKR); and b) an antibody heavy chain variable domain comprising the sequence of SEQ ID NO: 210 (QVQLVESGGGVVQPGRSLRLS-CAASGFDFNSYGMSWVRQAPGKGLEWVADIN-SKSYNYATYYAD SVKDRFTISRDNSKNTLYLQMNSL-RAEDTAVYYCARHHSDYFEYWGQGTLVTVSS). A non-limiting example of this type is a single chain antibody that comprises the sequence: DIQMTQSPSSLSAS-VGDRVTITCLASEDIYNNLAWYQQKPGKAPKLLI-YHASSLQDGVPSRFSGSGS GTDFTLTISSLQPEDFA-TYYCLQDSEYPPTFGQGTKVEIKRGGGGSGGGGS-GGGGSQVQLVESGGG VVQPGRSLRLSCAASGFDFNSYGMSWVRQAPGK-
GLEWVADINSKSYNYATYYADSVKDRFTISRD
NSKNTLYLQMNSLRAEDTAVYYCARHHSDYFEY-
WGQGTLVTVSS [SEQ ID NO: 211].

3. Agents that Target the OER Stress Inhibitor to β-Cells

The present inventors propose that targeting β-cell OER stress inhibitors directly to β-cells will be useful for treating diseases associated with aberrant β-cell OER stress, suitably with reduced off-target effects. In some embodiments, a β-cell OER stress inhibitor is associated with an agent that binds to a β-cell protein (e.g., a β-cell surface protein) that is more highly expressed on β-cells than one or more other cell types in the subject (e.g., epidermal cells, intestinal epithelial cells or hepatocytes). Non-limiting examples of β-cell proteins of this type and agents that bind to such proteins are described below.

3.1 Glucagon-Like Peptide 1 Receptor

The glucagon-like peptide 1 receptor (GLP-1R) is encoded by the GLP1R gene, which is highly expressed by β-cells, and expressed at very low levels in the skin and liver. Upon activation, GLP-1R stimulates the adenylyl cyclase pathway, resulting in increased insulin synthesis and release of insulin.

The natural agonist of GLP-1R is the peptide GLP-1, encoded by the Glucagon (GCG) gene. Preproglucagon is cleaved to produce two active GLP-1 peptides GLP-1$_{7-36}$ and GLP-1$_{6-36}$.

Several GLP-1 analogs are currently in therapeutic use for the treatment of type 2 diabetes, for example, exenatide and liraglutide. These molecules promote glucose-dependent insulin secretion, due to favorable effects on β-cell function, including suppression of ER stress. Accordingly, the use of GLP-1 and its analogs to target an OER stress inhibitor to a β-cell has the ability to provide dual benefits via GLP-1R activation.

Endogenous GLP-1 has a short half-life due to the actions of the dipeptidyl peptidase-IV (DPP-4) protease. Long-acting relatively protease resistant forms of GLP-1 are known, and can suitably be fused to or otherwise conjugated directly or indirectly to an OER stress inhibitor.

Non-limiting examples of GLP-1R agonists that are suitable for use as β-cell targeting agents include peptides or polypeptides comprising, consisting or consisting essentially of an amino acid sequence selected from:

(a) an amino acid sequence selected from: HDEFERHAE-GTFTSDVSSYLEGQAAKEFIAWLVKGRGRR [SEQ ID NO: 10], which corresponds to the amino acid sequence of native GLP-1,
HDEFERHAEGTFTSDVSSYLEGQAAKEFIAWLVK-GRG [SEQ ID NO: 12], which corresponds to the amino acid sequence of GLP-1$_{1-37}$,
HAEGTFTSDVSSYLEGQAAKEFIAWLVKGR [SEQ ID NO: 14], which corresponds to the amino acid sequence of GLP-1$_{7-36}$,
HAEGTFTSDVSSYLEGQAAKEFIAWLVKGRG [SEQ ID NO: 16], which corresponds to the amino acid sequence of GLP-1$_{7-37}$,
MKSIYFVAGLFVMLVQGSWQRSLQDTEEKSRSF-SASQADPLSDPDQMNEDKRHSQGTFTS DYSKY-LDSRRAQDFVQWLMNTKRNRNNIAKRH-DEFERHAEGTFTSDVSSYLEGQAAKEFIAWLV KGRGRRDFPEEVAIVEELGRRHADGSFSDEMN-TILDNLAARDFINWLIQTKITDRK [SEQ ID NO: 18], which corresponds to the amino acid sequence of glucagon preproprotein,
RSLQDTEEKSRSFSASQADPLSDPDQMNEDKRH-SQGTFTSDYSKYLDSRRAQDFVQWLM NTKRN-RNNIAKRHDEFERHAEGTFTSDVS-SYLEGQAAKEFIAWLVKGRGRRDFPEEVAIV-EELGR RHADGSFSDEMNTILDNLAARDFINWLIQTKIT-DRK [SEQ ID NO: 20], which corresponds to the amino acid sequence of glucagon proprotein,
HGEGTFTSDLSKQMEEEAVRLFIEWLKNGGPSS-GAPPPS [SEQ ID NO: 22], which corresponds to the amino acid sequence of Exendin-4, or
MVATKTFALLLLSLFLAVGLGEKKEGHFSAL-PSLPVGSHAKVSSPQPRGPRYAEGTFISDYSI AMDKIHQQDFVNWLLAQKGKKNDWKH-NITQREARALELASQANRKEEEAVEPQSS-PAKNPSDE DLLRDLLIQELLACLLDQTNLCRL-RSR [SEQ ID NO: 24], which corresponds to the amino acid sequence of gastric inhibitory polypeptide preproprotein, (b) an amino acid sequence that shares at least 70% (and at least 71% to at least 99% and all integer percentages in between) sequence similarity or sequence identity with the sequence set forth in any one of SEQ ID NO: 10, 12, 14, 16, 18, 20, 22 or 24; or (c) an amino acid sequence that is encoded by a nucleotide sequence selected from: cacgatgaatttgagagacatgct-gaagggacctttaccagtgatgtaagttcttatttggaaggccaagctgc-caaggaa ttcattgcttggctggtgaaaggccgaggaaggcga [SEQ ID NO: 9], which corresponds to the coding sequence for the amino acid sequence set forth in SEQ ID NO: 10, or
cacgatgaatttgagagacatgctgaagggacctttaccagtgatgtaagttctt-atttggaaggccaagctgccaa ggaattcattgcttggctggtgaaaggc-cgagga [SEQ ID NO: 11], which corresponds to the coding sequence for the amino acid sequence set forth in SEQ ID NO: 12,
catgctgaagggacctttaccagtgatgtaagttcttatttggaaggccaagct-gccaaggaattcattgcttggctg gtgaaaggccga [SEQ ID NO: 13], which corresponds to the coding sequence for the amino acid sequence set forth in SEQ ID NO: 14,
catgctgaagggacctttaccagtgatgtaagttcttatttggaaggccaagct-gccaaggaattcattgcttggctg gtgaaaggccgagga [SEQ ID NO: 15], which corresponds to the coding sequence for the amino acid sequence set forth in SEQ ID NO: 16,
atgaaaagcatttactttgtggctggattatttgtaatgctggtacaaggcagctg-gcaacgttcccttcaagacaca gaggagaaatccagatcattctcagcttc-ccaggcagacccactcagtgatcctgatcagatgaacgaggacaagcgcc attcacagggcacattcaccagtgactacagcaagtatctggactccag-gcgtgcccaagattttgtgcagtggttgatga ataccaagaggaacag-gaataacattgccaaacgtcacgatgaatttgagagacatgct-gaagggacctttaccagtga
tgtaagttcttatttggaaggccaagctgccaaggaattcattgcttggctg-gtgaaaggccgaggaaggcgagatttccc agaagaggtcgccattgtt-gaagaacttgccgcagacatgctgatggttctttctctgatgagat-gaacaccattcttgat
aatcttgccgccagggactttataaactggttgattcagaccaaaatcact-gacaggaaa[SEQ ID NO: 17], which corresponds to the coding sequence for the amino acid sequence set forth in SEQ ID NO: 18,
cgttcccttcaagacacagaggagaaatccagatcattctcagcttcccag-gcagacccactcagtgatcctgatca gatgaacgaggacaagcgccat-tcacagggcacattcaccagtgactacagcaagtatctggactccaggcgt-gcccaa
gattttgtgcagtggttgatgaataccaagaggaacaggaataacattgc-caaacgtcacgatgaatttgagagacatgc tgaagggacctttaccagtgatgtaagttcttatttggaaggccaagctgccaaggaattcattgcttg-
gctggtgaaaggc
cgaggaaggcgagatttcccagaagaggtcgccattgttgaagaacttg-
gccgcagacatgctgatggttcttctctgat gagatgaacaccattcttga-
taatcttgccgccagggactttataaactggttgattcagaccaaaatcact-
gacaggaaa [SEQ ID NO: 19], which corresponds to the coding sequence for the amino acid sequence set forth in SEQ ID NO: 20,
catggcgaaggcacctttaccagcgatctgagcaaacagatg-
gaagaagaagcggtgcgcctgtttattgaatggc tgaaaaacggcggc-
ccgagcagcggcgcgccgccgccgagc [SEQ ID NO: 21], which corresponds to the coding sequence for the amino acid sequence set forth in SEQ ID NO: 22, or
catggcgaaggcacctttaccagcgatctgagcaaacagatg-
gaagaagaagcggtgcgcctgtttattgaatggc tgaaaaacggcggc-
ccgagcagcggcgcgccgccgccgagc [SEQ ID NO: 23], which corresponds to the coding sequence for the amino acid sequence set forth in SEQ ID NO: 24;

(d) an amino acid sequence that is encoded by a nucleotide sequence that shares at least 70% (and at least 71% to at least 99% and all integer percentages in between) sequence identity with the sequence set forth in SEQ ID NO: 9, 11, 13, 15, 17, 19, 21 or 23, or a complement thereof; or (e) an amino acid sequence that is encoded by a nucleotide sequence that hybridizes under low, medium or high stringency conditions to the sequence set forth in any one of SEQ ID NO: 9, 11, 13, 15, 17, 19, 21 or 23, or a complement thereof, wherein the amino acid sequence of (a), (b), (c), (d) or (e) is an agonist of GLP-1R.

In specific embodiments, the GLP-1 agonist is selected from:

(1) HGEGTFTSDLSKQMEEEAVRLFIEWLKNG-GPSSGAPPPS-NH$_2$ [SEQ ID NO: 25], which is an amidated Exendin-4 analog (Exenatide, BYETTA);

(2) H(2-methyl)-AEGTFTSDVSSYLEGQAAKEFI-AWLVK(2-methyl)AR-CON H$_2$ [SEQ ID NO: 26] (Taspoglutide);

(3) HAEGTFTSDVSSYLEGQAA-K(E-palmitic acid)-DEFIAWLVRGRG [SEQ ID NO: 27] (Liraglutide, VICTOZA); or (4) HGEGTFTSDLSKQMEEEAVRLFIEWLKNG-GPSSGAPPSKKKKKK-NH$_2$ [SEQ ID NO: 28] (Lixisenatide, LYXUMIA).

(5) HG EGTFTSDVSSYLEGQAAKEFIAWLVKGRH-GEGTFTSDVSSYLEGQAAKEFIAWLV KGRMK-WVTFISLLFLFSSAYSRGVFRRDAHKSEVAH-RFKDLGEENFKALVLIAFAQYLQQCPFED HVKLVNEVTEFAKTCVADESAENCDKSLHTLF-GDKLCTVATLRETYGEMADCCAKQEPERNECFL QHKDDNPNLPRLVRPEVDVMCTAFHDNEET-FLKKYLYEIARRHPYFYAPELLFFAKRYKAAF-TECC QAADKAACLLPKLDELRDEGKASSAKQR-LKCASLQKFGERAFKAWAVARLSQRFPKAEFA-EVSKL VTDLTKVHTECCHGDLLECADDRADLAKYI-CENQDSISSKLKECCEKPLLEKSHCIAEVEN-DEMP ADLPSLAADFVESKDVCKNYAEAKDVFL-GMFLYEYARRHPDYSVVLLLRLAKTYETTLE-KCCAAAD PHECYAKVFDEFKPLVEEPQNLIKQNCELF-EQLGEYKFQNALLVRYTKKVPQVSTPTLVEVS-RNLG KVGSKCCKHPEAKRMPCAEDYLSVVLN-QLCVLHEKTPVSDRVTKCCTESLVNRRPCFSA-LEVDET YVPKEFNAETFTFHADICTLSEKERQIK-KQTALVELVKHKPKATKEQLKAVMDDFAAF-VEKCCKAD DKETCFAEEGKKLVAASQAALGL [SEQ ID NO: 29], which is a GLP-1 dimer fused to albumin (Albiglutide, EPERZAN TANZEUM).

(6) a GLP-1 analog selected from HX$_8$EGTFTSDVSSYLEGQAAKEFIAWLVKGGG [SEQ ID NO: 30], wherein X$_8$ is selected from G or V; HX$_8$EGTFTSDVSSYLEGQAAKEFIAWLKNGGG [SEQ ID NO: 31], wherein X$_8$ is selected from G or V; HX$_8$EGTFTSDVSSYLEGQAAKEFIAWLVKGGP [SEQ ID NO: 32], wherein X$_8$ is selected from G or V; HX$_8$EGTFTSDVSSYLEGQAAKEFIAWLKNGGP [SEQ ID NO: 33], wherein X$_8$ is selected from G or V; HX$_8$EGTFTSDVSSYLEGQAAKEFIAWLVKGG [SEQ ID NO: 34], wherein X$_8$ is selected from G or V; or HX$_8$EGTFTSDVSSYLEGQAAKEFIAWLKNGG [SEQ ID NO: 35], wherein X$_8$ is selected from G or V, wherein the GLP-1 analog is fused to the Fc portion of an immunoglobulin comprising the sequence AESKYGPPCPPCPAPX$_{16}$X$_{17}$X$_{18}$GGPSVFLFPPKP-KDTLMISRTPEVTCVVVDVSQEDPEVQFNWYV DGVEVHNAKTKPREEQFX$_{80}$STYRVVSVLTVL-HQDWLNGKEYKCKVSNKGLPSSIEKTISKAKGQ PREPQVYTLPPSQEEMTKNQVSLTCLVKGFYPS-DIAVEWESNGQPENNYKTTPPVLDSDGSFFLY SRLTVDKSRWQEGNVFSCSVMHEALHN-HYTQKSLSLSLGX$_{230}$ [SEQ ID NO: 36], wherein X$_{16}$ is selected from P or E, X$_{17}$ is selected from F, V or A, X$_{18}$ is selected from L, E or A, and X$_{230}$ is K or is absent.

Alternatively, the GLP-1R agonist may be selected from small molecules, illustrative examples of which include hydroxylflavonols such as 4' hydroxylflavonol, 3',4' hydroxylflavonol, and quercetin.

In other embodiments, the GLP-1R binding agent is an agonistic antigen-binding molecule that is immuno-interactive with GLP-1R. Representative antigen-binding molecules of this type include monoclonal antibody 5A10, as described, for example, in US 2006/0275288, which is hereby incorporated by reference herein in its entirety, as well as antigen-binding fragments of monoclonal antibody 5A10 and humanized or chimeric antibodies and antigen-binding fragments thereof. Monoclonal 5A10 antibody comprises:

the light chain variable region amino acid sequence: QIV-LTQSPAIMSASPGEKVTMTCSASSRVTYMHWY-QQRSGTSPKRWIYDTSKLASGVPARFSGSGS GTSYS-LTISSMEAEDAATYYCQQWGNNPQYTFGGGTRLEIKR [SEQ ID NO: 37]; and the heavy chain variable region amino acid sequence: QVTLKESGPGILQPSQTLSLTCSFSGFSLSTSGTGVG-WIRQPSGKGLEWLSHIWWDDVKRYNPALK SRLTISRDTSYSQVFLRIASVDTADTATYYCARILDGT-GPMDYWGQGTSVTVSS [SEQ ID NO: 38].

Also contemplated are antibodies and antigen-binding fragments that comprise the light chain and heavy chain complementarity determining region (CDR) sequences of the 5A10 monoclonal antibody, wherein the light chain CDR sequences comprise CDR1 of SEQ ID NO: 39 (SASSRV-TYMH); CDR2 of SEQ ID NO: 40 (DTSKLAS); and CDR3 of SEQ ID NO: 41 (QQWGNNPQYT), and the heavy chain CDR sequences comprise CDR1 of SEQ ID NO: 42 (GF-SLSTSGTGVG); CDR2 of SEQ ID NO: 43 (HIWWD-DVKRYNPALKS) and CDR3 of SEQ ID NO: 44 (ILDGT-GPMDY). In specific embodiments, these antibodies or antigen-binding fragments comprise human antibody framework (FR) and constant region sequences with one or more framework region amino acid residues substituted from the corresponding framework region sequences of the parent 5A10 antibody.

In illustrative examples of this type, the antigen-binding molecule is a single chain Fv (scFv) antibody comprising, consisting or consisting essentially of the amino acid sequence:

[SEQ ID NO: 45]
QIVLTQSPAIMSASPGEKVTMTCSASSRVTYMHWYQQRSGTSPKRWIYDT

SKLASGVPARFSGSGSGTSYSLTISSMEAEDAATYYCQQWGNNPQYTFGG

GTRLEIKRGGGGSGGGGSGGGGSGGGGSQVTLKESGPGILQPSQTLSLTC

SFSGFSLSTSGTGVGWIRQPSGKGLEWLSHIWWDDVKRYNPALKSRLTIS

RDTSYSQVFLRIASVDTADTATYYCARILDGTGPMDYWGQGTSVTVSS.

3.2 Sulfonylurea Receptor

The sulfonylurea receptor is an inward-rectifier potassium ion channel that is highly expressed by β-cells. The ATP-sensitive K$^+$ channel receptor is composed from two major subunits: SUR1 (encoded by the gene ABCC8) and Kir6.2 (encoded by the gene KCNJ11).

Kir6.2 is also expressed in cardiac and skeletal muscle. In the intestine expression of Kir6.2 is restricted to relatively rare enteroendocrine cells, L-cells and K-cells. The receptor is the target for a broadly used class of type 2 diabetes therapeutics, the sulfonylureas, for example GLIPIZIDE, GLICLAZIDE and GLIBENCLAMIDE, which drive insulin secretion in a glucose-independent manner.

Notably, it is only essential that the sulfonylurea bind the sulfonylurea receptor as it is used primarily to target the OER stress inhibitor to the β-cell. Thus, it is not necessary for the sulfonylurea to exert its biological activity. In fact, in accordance with the present invention, the OER stress inhibitor IL-22 is administered to a subject at a concentration of between 20-100 µg/kg (1.25-6 nmoles/kg). On the other hand, the sulfonylureas are administered at a concentration of between 10-200 mg/kg (~30-600 µmoles/kg). Therefore, the sulfonylurea in the conjugate will have virtually no activity due to the low concentration.

Non-limiting examples of sulfonylurea receptor agonists that are suitable for use with the present invention include:

α-endosulfine:

[SEQ ID NO: 46]
MSQKQEEENPAEETGEEKQDTQEKEGILPERAEEAKLKAKYPSLGQKPGG

SDFLMKRLQKGQKYFDSGDYNMAKAKMKNKQLPSAGPDKNLVTGDHIPTP

QDLPQRKSSLVTSKLAGGQV;

Amino Gliclazide:

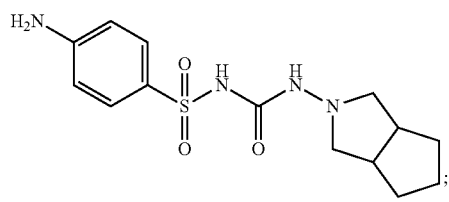

Carboxy Gliclazide:

-continued

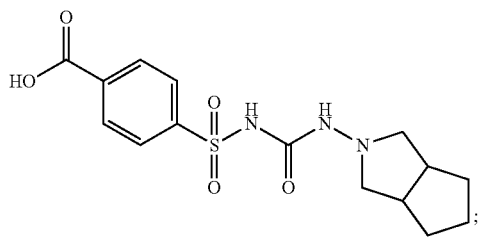

Amino Glipizide:

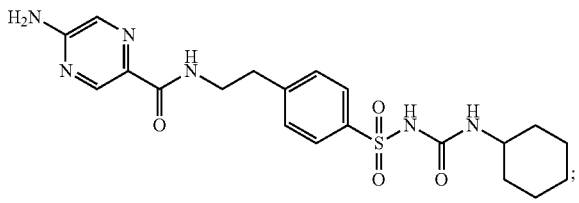

Carbutamide (GLUCIDORAL):

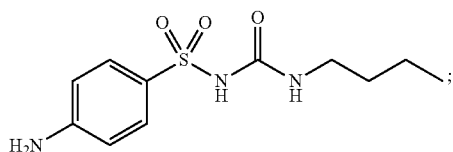

Acetohexamide (DYMELOR):

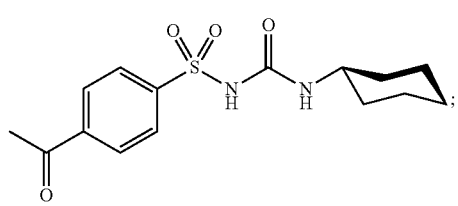

Chloropropamide (DIABINESE):

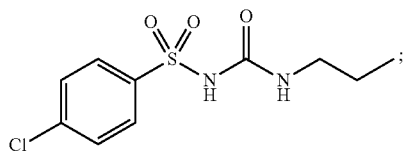

Tolbutamide (ORINASE):

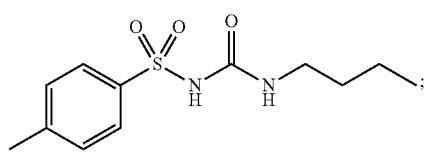

Tolazamide (TOLINASE):

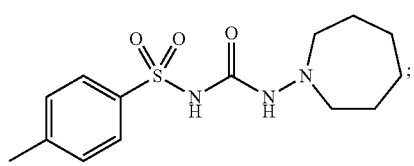

Glibenclamide (DIABETA, GLYNASE, MICRONASE, DAONIL, SEMIDAONIL, EUGLUCON, DELMIDE):

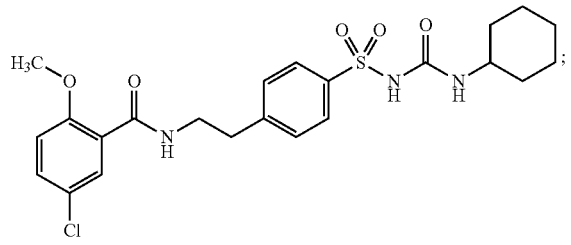

Glibornuride:

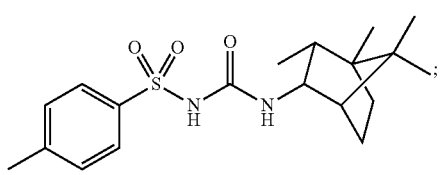

Gliquidone (GLURENORM):

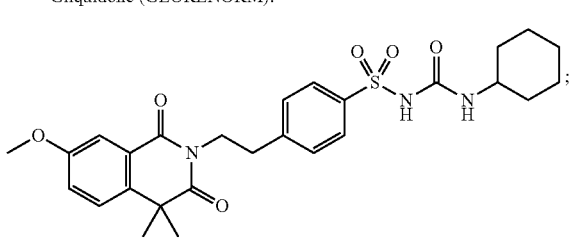

Glisoxepide:

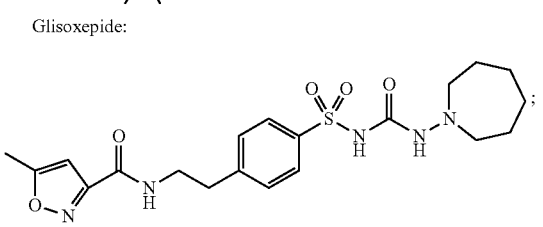

Glyclopyramide (DEAMELIN-S):

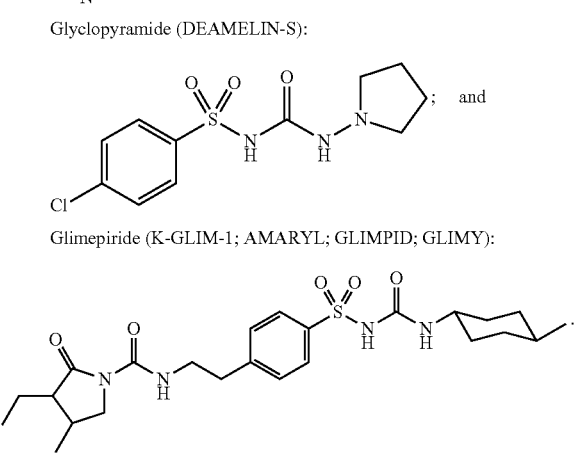

Glimepiride (K-GLIM-1; AMARYL; GLIMPID; GLIMY):

AMG-837:

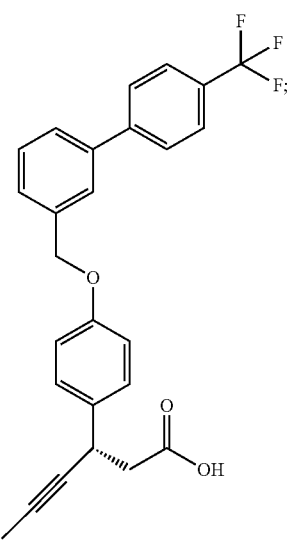

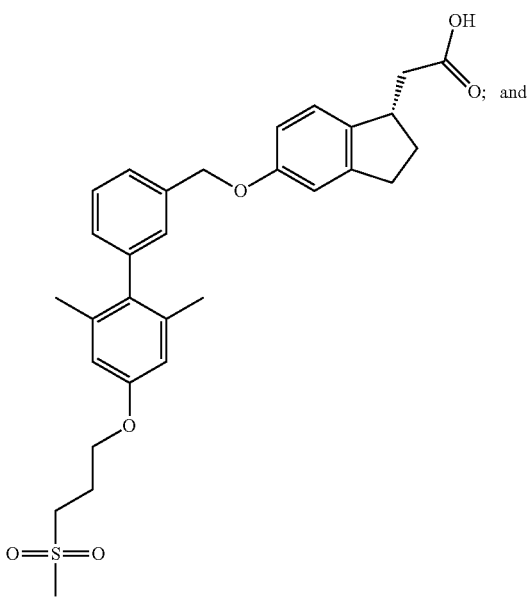

TAK-875
LY 2881836 (Eli Lilly and Company).

3.3 Free Fatty Acid Receptor 1 (FFA1)

Free fatty acid receptor 1 (FFA1), also known as GPR40, is a class A G-protein coupled receptor that in humans is encoded by the FFAR1 gene. It is strongly expressed in the cells of the pancreas and to a lesser extent in the brain. This membrane protein binds free fatty acids, acting as a nutrient sensor for regulating energy homeostasis. Agonists of this receptor are useful for reducing HbA1c in type 2 diabetes patients. Accordingly, the present invention also contemplates conjugating GPR40 agonists to an OER stress inhibitor. Non-limiting examples of such agonists include:

3.4G Protein-Coupled Receptor 119 (GPR119)

GPR119 is expressed predominantly in the pancreas and gastrointestinal tract in rodents and humans, as well as in the brain in rodents. Activation of the receptor has been shown to cause insulin release in β-cells, a reduction in food intake and body weight gain in rats. GPR119 has also been shown to regulate incretin and insulin hormone secretion. As a result, drugs acting on the receptor have been developed for treatment of obesity and diabetes. Thus, the present invention also contemplates conjugating GPR119 agonists to an OER stress inhibitor. Illustrative agonists of this type include:

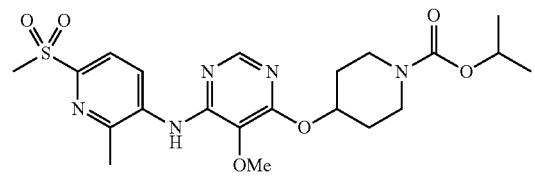

JNJ-38431055
(APD597)

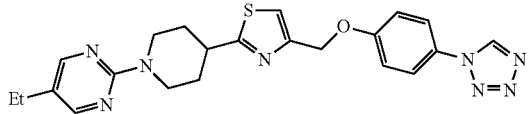

MBX-2982

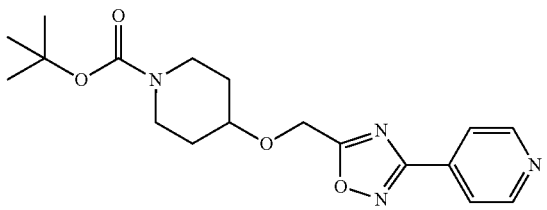

PSN632408

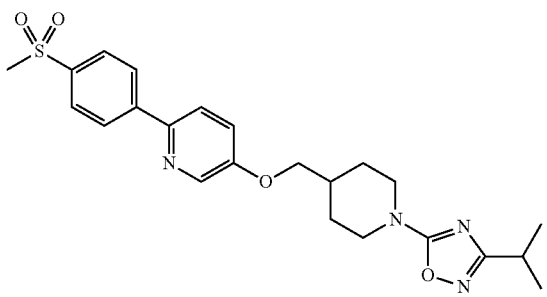

GSK1292263

Alternative GPR119 agonists are described in X.-Y. Ye et al. (2014, *Bioorg. Med. Chem. Lett.* 24 (2014) 2539-2545), which is hereby incorporated by reference herein in its entirety.

3.5 Unspecified β-Cell Surface Antigen

In some embodiments, the β-cell targeting agent is an antigen-binding molecule that is immuno-interactive with an unspecified/uncharacterized antigen on the surface of pancreatic β-cells, as disclosed for example in WO 2010/096930, the contents of which are hereby incorporated herein in their entirety. These antigen-binding molecules bind selectively to pancreatic β-cells and comprise a heavy chain variable sequence selected from:

[SEQ ID NO: 47]
EVQLLESGGGLVQPGGSLRLSCAASGFTFSSYAMSWVRQAPGKGLEWVSS
ITAEGTHTWYADSVKGRFTISRDNSKNTLYLQMNSLRAEDTAVYYCAKTS
YRFDYWGQGTLVT;

[SEQ ID NO: 48]
EVQLLESGGGLVQPGGSLRLSCAASGFTFSSYAMSWVRQAPGKGLEWVSR
IKIFGSKTKFADSVKGRFTISRDNSKNTLYLQMNSLRAEDTAVYYCAKHS
THFDYWGQGTLVT;

[SEQ ID NO: 49]
EVQLLESGGGLVQPGGSLRLSCAASGFTFSSYAMSWVRQAPGKGLEWVSS
IHPKGYPTRYADSVKGRFTISRDNSKNTLYLQMNSLRAEDTAVYYCAKST
TPFDYWGQGTLVT;

[SEQ ID NO: 50]
EVQLLESGGGLVQPGGSLRLSCAASGFTFSSYAMSWVRQAPGKGLEWVSR
IQFFGSHTYFADSVKGRFTISRDNSKNTLYLQMNSLRAEDTAVYYCAKHS
THFDYWGQGTLVT;

[SEQ ID NO: 51]
EVQLLESGGGLVQPGGSLRLSCAASGFTFSSYAMSWVRQAPGKGLEWVSS
ISSTGDSTSYADSVKGRFTISRDNSKNTLYLQMNSLRAEDTAVYYCAKAA
DSFDYWGQGTLVT, and a light chain variable region selected from:

[SEQ ID NO: 52]
DIQMTQSPSSLSASVGDRVTITCRASQSISSYLNWYQQKPGKAPKLLIYK
ASRLQSGVPSRFSGSGSGTDFTLTISSLQPEDFATYYCQQKWDPPRTFGQ
GTKVEIKR;

[SEQ ID NO: 53]
DIQMTQSPSSLSASVGDRVTITCRASQSISSYLNWYQQKPGKAPKLLIYR
ASSLQSGVPSRFSGSGSGTDFTLTISSLQPEDFATYYCQQLQSTPRTFGQ
GTKVEIKR;

[SEQ ID NO: 54]
DIQMTQSPSSLSASVGDRVTITCRASQSISSYLNWYQQKPGKAPKLLIYA
ASSLQSGVPSRFSGSGSGTDFTLTISSLQPEDFATYYCQQMGRDPRTFGQ
GTKVEIKR;

[SEQ ID NO: 55]
DIQMTQSPSSLSASVGDRVTITCRASQSISSYLNWYQQKPGKAPKLLIYR
ASILQSGVPSRFSGSGSGTDFTLTISSLQPEDFATYYCQQNRRIPRTFGQ
GTKVEIKR;

[SEQ ID NO: 56]
DIQMTQSPSSLSASVGDRVTITCRASQSISSYLNWYQQKPGKAPKLLIYG
ASSLQSGVPSRFSGSGSGTDFTLTISSLQPEDFATYYCQQTNGAPTTFGQ
GTKVEIKR.

In specific embodiments, antigen-binding molecules of this type are single chain antibodies (e.g., scFv) comprising an amino acid sequence selected from:

[SEQ ID NO: 57]
AMAEVQLLESGGGLVQPGGSLRLSCAASGFTFSSYAMSWVRQAPGKGLEW
VSSITAEGTHTWYADSVKGRFTISRDNSKNTLYLQMNSLRAEDTAVYYCA
KTSYRFDYWGQGTLVTVSSGGGGSGGGGSGGGGSTDIQMTQSPSSLSASV
GDRVTITCRASQSISSYLNWYQQKPGKAPKLLIYKASRLQSGVPSRFSGS
GSGTDFTLTISSLQPEDFATYYCQQKWDPPRTFGQGTKVEIKRAAAHHHH
HHGAAEQKLISEEDLN;

-continued

[SEQ ID NO: 58]
AMAEVQLLESGGGLVQPGGSLRLSCAASGFTFSSYAMSWVRQAPGKGLEW

VSRIKIFGSKTKFADSVKGRFTISRDNSKNTLYLQMNSLRAEDTAVYYCA

KHSTHFDYWGQGTLVTVSSGGGGSGGGGSGGGGSTDIQMTQSPSSLSASV

GDRVTITCRASQSISSYLNWYQQKPGKAPKLLIYRASSLQSGVPSRFSGS

GSGTDFTLTISSLQPEDFATYYCQQLQSTPRTFGQGTKVEIKRAAAHHHH

HHGAAEQKLISEEDLN;

[SEQ ID NO: 59]
AMAEVQLLESGGGLVQPGGSLRLSCAASGFTFSSYAMSWVRQAPGKGLEW

VSSIHPKGYPTRYADSVKGRFTISRDNSKNTLYLQMNSLRAEDTAVYYCA

KSTTPFDYWGQGTLVTVSSGGGGSGGGGSGGGGSTDIQMTQSPSSLSASV

GDRVTITCRASQSISSYLNWYQQKPGKAPKLLIYAASSLQSGVPSRFSGS

GSGTDFTLTISSLQPEDFATYYCQQMGRDPRTFGQGTKVEIKRAAAHHHH

HHGAAEQKLISEEDLN;

[SEQ ID NO: 60]
AMAEVQLLESGGGLVQPGGSLRLSCAASGFTFSSYAMSWVRQAPGKGLEW

VSRIQFFGSHTYFADSVKGRFTISRDNSKNTLYLQMNSLRAEDTAVYYCA

KHSTHFDYWGQGTLVTVSSGGGGSGGGGSGGGGSTDIMTQSPSSLSASVG

DRVTITCRASQSISSYLNWYQQKPGKAPKLLIYRASILQSGVPSRFSGSG

SGTDFTLTISSLQPEDFATYYCQQNRRIPRTFGQGTKVEIKRAAAHHHHH

HGAAEQKLISEEDLN;
or

[SEQ ID NO: 61]
AMAEVQLLESGGGLVQPGGSLRLSCAASGFTFSSYAMSWVRQAPGKGLEW

VSSISSTGDSTSYADSVKGRFTISRDNSKNTLYLQMNSLRAEDTAVYYCA

KAADSFDYWGQGTLVTVSSGGGGSGGGGSGGGGSTDIQMTQSPSSLSASV

GDRVTITCRASQSISSYLNWYQQKPGKAPKLLIYGASSLQSGVPSRFSGS

GSGTDFTLTISSLQPEDFATYYCQQTNGAPTTFGQGTKVEIKRAAAHHHH

HHGAAEQKLISEEDLN.

Also contemplated are antibodies and antigen-binding fragments that comprise the light chain and heavy chain complementarity determining region (CDR) sequences of the heavy and light chain variable regions listed above, wherein the heavy chain CDR sequences comprise CDR1 of SEQ ID NO: 62 (SYAMS); a CDR2 selected from SEQ ID NO: 63 (SITAEGTHTWYADSVKG), SEQ ID NO: 64 (RIKIFGSKTKFADSVKG), SEQ ID NO: 65 (SIHPKGYPTRYADSVKG), SEQ ID NO: 66 (RIQFFGSHTYFADSVKG) or SEQ ID NO: 67 (SISSTGDSTSYADSVKG); and a CDR3 selected from SEQ ID NO: 68 (TSYRFDY), SEQ ID NO: 69 (HSTHFDY), SEQ ID NO: 70 (STTPFDY) or SEQ ID NO: 71 (AADSFDY), and the light chain CDR sequences comprise CDR1 of SEQ ID NO: 72 (RASQSISSYLN); a CDR2 selected from SEQ ID NO: 73 (KASRLQS), SEQ ID NO: 74 (RASSLQS), SEQ ID NO: 75 (AASSLQS), SEQ ID NO: 76 (RASILQS), or SEQ ID NO: 77 (GASSLQS), and a CDR3 selected from SEQ ID NO: 78 (QQKWDPPRT), SEQ ID NO: 79 (QQLQSTPRT), SEQ ID NO: 80 (QQMGRDPRT), SEQ ID NO: 81 (QQNRRIPRT) or SEQ ID NO: 82 (QQTNGAPTT).

In illustrative examples of this type, the antibody or antigen-binding fragments that comprise:

heavy chain CDR sequences comprising a CDR1 of SEQ ID NO: 62 (SYAMS); a CDR2 of SEQ ID NO: 63 (SITAEGTHTWYADSVKG) and a CDR3 of SEQ ID NO: 68 (TSYRFDY), and light chain CDR sequences comprising a CDR1 of SEQ ID NO: 72 (RASQSISSYLN); a CDR2 of SEQ ID NO: 73 (KASRLQS) and a CDR3 of SEQ ID NO: 78 (QQKWDPPRT);

heavy chain CDR sequences comprising a CDR1 of SEQ ID NO: 62 (SYAMS); a CDR2 of SEQ ID NO: 65 (SIHPKGYPTRYADSVKG) and a CDR3 of SEQ ID NO: 69 (HSTHFDY), and light chain CDR sequences comprising a CDR1 of SEQ ID NO: 72 (RASQSISSYLN); a CDR2 of SEQ ID NO: 74 (RASSLQS) and a CDR3 of SEQ ID NO: 79 (QQLQSTPRT);

heavy chain CDR sequences comprising a CDR1 of SEQ ID NO: 62 (SYAMS); a CDR2 of SEQ ID NO: 64 (RIKIFGSKTKFADSVKG) and a CDR3 of SEQ ID NO: 70 (STTPFDY), and light chain CDR sequences comprising a CDR1 of SEQ ID NO: 72 (RASQSISSYLN); a CDR2 of SEQ ID NO: 75 (AASSLQS) and a CDR3 of SEQ ID NO: 80 (QQMGRDPRT);

heavy chain CDR sequences comprising a CDR1 of SEQ ID NO: 62 (SYAMS); a CDR2 of SEQ ID NO: 66 (RIQFFGSHTYFADSVKG) and a CDR3 of SEQ ID NO: 69 (HSTHFDY), and light chain CDR sequences comprising a CDR1 of SEQ ID NO: 72 (RASQSISSYLN); a CDR2 of SEQ ID NO: 76 (RASILQS) and a CDR3 of SEQ ID NO: 81 (QQNRRIPRT); or heavy chain CDR sequences comprising a CDR1 of SEQ ID NO: 62 (SYAMS); a CDR2 of SEQ ID NO: 67 (SISSTGDSTSYADSVKG) and a CDR3 of SEQ ID NO: 71 (AADSFDY), and light chain CDR sequences comprising a CDR1 of SEQ ID NO: 72 (RASQSISSYLN); a CDR2 of SEQ ID NO: 77 (GASSLQS) and a CDR3 of SEQ ID NO: 82 (QQTNGAPTT).

In specific embodiments, the above antibodies or antigen-binding fragments comprise human antibody framework (FR) and constant region sequences with one or more framework region amino acid residues substituted from the corresponding framework region sequences of the parent scFv antibodies SCA B1, SCA B2, SCA B3, SCA B4 or SCA B5, as taught in WO 2010/096930.

Alternative β-cell specific antibodies and methods for their preparation are described, for example, by Sung et al. (Mol Cancer Ther. 2009 August; 8(8):2276-85), Feng et al. (MAbs. 2010 September-October; 2(5):565-70), Chen et al. (Cell Research (2009) 19:984-995).

4. Conjugation/Fusion

The present invention contemplates any suitable method for conjugating or fusing β-cell binding agents to OER stress inhibitors, non-limiting examples of which include:

(i) Use of a carbodiimide or other suitable coupling agent to form an amide linkage between a free amino group of a β-cell binding agent and the free carboxyl group of an OER stress inhibitor protein or a linker peptide fused or otherwise attached to the OER stress inhibitor protein;

(ii) Use of a carbodiimide or other suitable coupling agent to form an amide linkage between a free amino group of an OER stress inhibitor protein and the free carboxyl group of a β-cell binding agent or a linker peptide fused or otherwise attached to the β-cell binding agent;

(iii) Use of MBS (m-maleimidonemzoic acid N-hydroxysuccinimide ester) to link via the thiol group of a cysteine added to the C-terminus of an OER stress inhibitor protein or to the C-terminus of a linker peptide attached or otherwise fused to an OER stress inhibitor protein, to the free amino group at the N-terminus of the a β-cell binding protein;

(iv) Use of MBS (m-maleimidonemzoic acid N-hydroxysuccinimide ester) to link via the thiol group of a cysteine added to the C-terminus of a β-cell binding agent (suitably a β-cell binding protein) or to the C-terminus of a linker peptide attached or otherwise fused to a β-cell binding agent (suitably a β-cell binding protein), to the free amino group at the N-terminus of the an OER stress inhibitor protein;

(v) Use of glutaraldehyde to conjugate a free amino group on an OER-stress inhibitor protein or on a linker protein fused or otherwise attached to an OER-stress inhibitor protein and a free amino group on a β-cell binding agent (suitably a β-cell binding protein) or on a linker protein fused or otherwise attached to a β-cell binding agent (suitably a β-cell binding protein);

(vi) Use of $SO_2Cl$ or triazoles to couple an amine of an OER-stress inhibitor protein to an aldehyde-containing moiety of a β-cell binding agent (suitably a β-cell binding protein); or (vii) Use of $SO_2Cl$ or triazoles to couple an amine of a β-cell binding agent (suitably a β-cell binding protein) to an aldehyde-containing moiety of an OER-stress inhibitor protein.

In illustrative examples of conjugating sulfonylurea compounds with amino or carboxy groups to an OER stress inhibitor protein, these compounds can be conjugated to the C- or N-terminus of the protein, either with or without linker peptides extending from those termini, by recombinant fusion or by peptide-peptide covalent conjugation. For instance, such conjugates may be made through: (a) use of a carbodiimide to form an amide linkage between a free amino group on the amino-sulfonylureas and the free carboxyl group on the C-terminus of OER stress inhibitor or the spacer peptide; or (b) use of a carbodiimide to form an amide linkage between a free carboxy group on the carboxysulfonylureas and the free amino group on the N-terminus of the OER stress inhibitor or the spacer peptide. Linker peptides could be prepared with several spaced reactive residues via which to conjugate multiple sulfonylurea compounds.

In specific embodiments, conjugates/fusions of a β-cell binding protein and an OER stress inhibitor protein, with or without intervening linkers, can be made by peptide synthesis or by recombinant expression using any suitable prokaryotic or eukaryotic expression system (including but not limited to bacterial, yeast, insect and mammalian cells), as known in the art.

5. Chimeric Constructs

One aspect of the present invention relates to chimeric constructs that comprise an OER stress inhibitor polypeptide that is fused to or otherwise conjugated, either directly or via a linker, to a proteinaceous β-cell targeting agent. In specific embodiments, the OER stress inhibitor is an IL-22 polypeptide and the targeting agent is a proteinaceous GLP-1R agonist. Illustrative constructs may comprise small GLP-1 peptides and peptide analogs, representative examples of which include:

[SEQ ID NO: 83]
(a) MXHDEFERHAEGTFTSDVSSYLEGQAAKEFIAWLVKGRGRR[GGGGSGGGGSGGGG
SGGGGS]$_n$APISSHCRLDKSNFQQPYITNRTFMLAKEASLADNNTDVRLIGEKLFHGVSMSERCYLM
KQVLNFTLEEVLFPQSDRFQPYMQEVVPFLARLSNRLSTCHIEGDDLHIQRNVQKLKDTVKKLGESG
EIKAIGELDLLFMSLRNACI;

[SEQ ID NO: 84]
(b) MXHDEFERHAEGTFTSDVSSYLEGQAAKEFIAWLVKGRGRR[GGGSGGGS]$_n$APISSH
CRLDKSNFQQPYITNRTFMLAKEASLADNNTDVRLIGEKLFHGVSMSERCYLMKQVLNFTLEEVLFPQ
SDRFQPYMQEVVPFLARLSNRLSTCHIEGDDLHIQRNVQKLKDTVKKLGESGEIKAIGELDLLFMSLR
NACI;

[SEQ ID NO: 85]
(c) MXHDEFERHAEGTFTSDVSSYLEGQAAKEFIAWLVKGRGRR[GGGG]$_n$APISSHCRLDK
SNFQQPYITNRTFMLAKEASLADNNTDVRLIGEKLFHGVSMSERCYLMKQVLNFTLEEVLFPQSDRF
QPYMQEVVPFLARLSNRLSTCHIEGDDLHIQRNVQKLKDTVKKLGESGEIKAIGELDLLFMSLRNACI;

[SEQ ID NO: 86]
(d) MXHDEFERHAEGTFTSDVSSYLEGQAAKEFIAWLVKGRGRR[GGGGG]$_n$APISSHCRL
DKSNFQQPYITNRTFMLAKEASLADNNTDVRLIGEKLFHGVSMSERCYLMKQVLNFTLEEVLFPQSD
RFQPYMQEVVPFLARLSNRLSTCHIEGDDLHIQRNVQKLKDTVKKLGESGEIKAIGELDLLFMSLRNA
CI;

-continued

[SEQ ID NO: 87]
(e) MXHDEFERHAEGTFTSDVSSYLEGQAAKEFIAWLVKGRGRR[GGGKGGGG]$_n$*APISSH*
*CRLDKSNFQQPYITNRTFMLAKEASLADNNTDVRLIGEKLFHGVSMSERCYLMKQVLNFTLEEVLFPQ*
*SDRFQPYMQEVVPFLARLSNRLSTCHIEGDDLHIQRNVQKLKDTVKKLGESGEIKAIGELDLLFMSLR*
*NACI*;

[SEQ ID NO: 88]
(f) MXHDEFERHAEGTFTSDVSSYLEGQAAKEFIAWLVKGRGRR[GGGNGSGG]$_n$*APISSHC*
*RLDKSNFQQPYITNRTFMLAKEASLADNNTDVRLIGEKLFHGVSMSERCYLMKQVLNFTLEEVLFPQS*
*DRFQPYMQEVVPFLARLSNRLSTCHIEGDDLHIQRNVQKLKDTVKKLGESGEIKAIGELDLLFMSLRN*
*ACI*;

[SEQ ID NO: 89]
(g) MXHDEFERHAEGTFTSDVSSYLEGQAAKEFIAWLVKGRGRR[GGGCGGGG]$_n$*APISSH*
*CRLDKSNFQQPYITNRTFMLAKEASLADNNTDVRLIGEKLFHGVSMSERCYLMKQVLNFTLEEVLFPQ*
*SDRFQPYMQEVVPFLARLSNRLSTCHIEGDDLHIQRNVQKLKDTVKKLGESGEIKAIGELDLLFMSLR*
*NACI*;

[SEQ ID NO: 90]
(h) MXHDEFERHAEGTFTSDVSSYLEGQAAKEFIAWLVKGRGRR[GPNGG]$_n$*APISSHCRLD*
*KSNFQQPYITNRTFMLAKEASLADNNTDVRLIGEKLFHGVSMSERCYLMKQVLNFTLEEVLFPQSDRF*
*QPYMQEVVPFLARLSNRLSTCHIEGDDLHIQRNVQKLKDTVKKLGESGEIKAIGELDLLFMSLRNACI*;
and

[SEQ ID NO: 91]
(i) MXHDEFERHAEGTFTSDVSSYLEGQAAKEFIAWLVKGRGRR*APISSHCRLDKSNFQQPY*
*ITNRTFMLAKEASLADNNTDVRLIGEKLFHGVSMSERCYLMKQVLNFTLEEVLFPQSDRFQPYMQEV*
*VPFLARLSNRLSTCHIEGDDLHIQRNVQKLKDTVKKLGESGEIKAIGELDLLFMSLRNACI*,
wherein:

HDEFERHAEGTFTSDVSSYLEGQAAKEFIAWLVKGRGRR = native GLP-1;

Underlined Text is Flexible Linker;
Text in italics is IL-22 mature polypeptide;
M is an artificial methionine for recombinant expression;
n=1 or more, suitably 1, 2, 3, 4, 5, 6, 7, 8, 9 or 10; and
X is an optional tag (e.g., $FLAG_S$, $His_6$) for purification,
or

[SEQ ID NO: 92]
(j) MX*APISSHCRLDKSNFQQPYITNRTFMLAKEASLADNNTDVRLIGEKLFHGVSMSERCY*
*LMKQVLNFTLEEVLFPQSDRFQPYMQEVVPFLARLSNRLSTCHIEGDDLHIQRNVQKLKDTVKKLGE*
*SGEIKAIGELDLLFMSLRNACI*[GGGGSGGGGSGGGGSGGGGS]$_n$HDEFERHAEGTFTSDVSSYLEG
QAAKEFIAWLVKGRGRR;

[SEQ ID NO: 93]
(k) MX*APISSHCRLDKSNFQQPYITNRTFMLAKEASLADNNTDVRLIGEKLFHGVSMSERCY*
*LMKQVLNFTLEEVLFPQSDRFQPYMQEVVPFLARLSNRLSTCHIEGDDLHIQRNVQKLKDTVKKLGE*
*SGEIKAIGELDLLFMSLRNACI*[GGGSGGGS]$_n$HDEFERHAEGTFTSDVSSYLEGQAAKEFIAWLVKG
RGRR;

[SEQ ID NO: 94]
(l) MX*APISSHCRLDKSNFQQPYITNRTFMLAKEASLADNNTDVRLIGEKLFHGVSMSERCY*
*LMKQVLNFTLEEVLFPQSDRFQPYMQEVVPFLARLSNRLSTCHIEGDDLHIQRNVQKLKDTVKKLGE*
*SGEIKAIGELDLLFMSLRNACI*[GGGG]$_n$HDEFERHAEGTFTSDVSSYLEGQAAKEFIAWLVKGRGRR;

-continued (m) MX_APISSHCRLDKSNFQQPYITNRTFMLAKEASLADNNTDVRLIGEKLFHGVSMSERC_ [SEQ ID NO: 95]
_YLMKQVLNFTLEEVLFPQSDRFQPYMQEVVPFLARLSNRLSTCHIEGDDLHIQRNVQKLKDTVKKLGE_
_SGEIKAIGELDLLFMSLRNACI_[<u>GGGGG</u>]<sub>n</sub>HDEFERHAEGTFTSDVSSYLEGQAAKEFIAWLVKGRGR
R;

(n) MX_APISSHCRLDKSNFQQPYITNRTFMLAKEASLADNNTDVRLIGEKLFHGVSMSERCY_ [SEQ ID NO: 96]
_LMKQVLNFTLEEVLFPQSDRFQPYMQEVVPFLARLSNRLSTCHIEGDDLHIQRNVQKLKDTVKKLGE_
_SGEIKAIGELDLLFMSLRNACI_[<u>GGGKGGGG</u>]<sub>n</sub>HDEFERHAEGTFTSDVSSYLEGQAAKEFIAWLVKG
RGRR;

(o) MX_APISSHCRLDKSNFQQPYITNRTFMLAKEASLADNNTDVRLIGEKLFHGVSMSERCY_ [SEQ ID NO: 97]
_LMKQVLNFTLEEVLFPQSDRFQPYMQEVVPFLARLSNRLSTCHIEGDDLHIQRNVQKLKDTVKKLGE_
_SGEIKAIGELDLLFMSLRNACI_[<u>GGGNGSGG</u>]<sub>n</sub>HDEFERHAEGTFTSDVSSYLEGQAAKEFIAWLVKG
RGRR;

(p) MX_APISSHCRLDKSNFQQPYITNRTFMLAKEASLADNNTDVRLIGEKLFHGVSMSERCY_ [SEQ ID NO: 98]
_LMKQVLNFTLEEVLFPQSDRFQPYMQEVVPFLARLSNRLSTCHIEGDDLHIQRNVQKLKDTVKKLGE_
_SGEIKAIGELDLLFMSLRNACI_[<u>GGGCGGGG</u>]<sub>n</sub>HDEFERHAEGTFTSDVSSYLEGQAAKEFIAWLVKG
RGRR;

(q) MX_APISSHCRLDKSNFQQPYITNRTFMLAKEASLADNNTDVRLIGEKLFHGVSMSERCY_ [SEQ ID NO: 99]
_LMKQVLNFTLEEVLFPQSDRFQPYMQEVVPFLARLSNRLSTCHIEGDDLHIQRNVQKLKDTVKKLGE_
_SGEIKAIGELDLLFMSLRNACI_[<u>GPNGG</u>]<sub>n</sub>HDEFERHAEGTFTSDVSSYLEGQAAKEFIAWLVKGRGR
R;
and (r) MX_APISSHCRLDKSNFQQPYITNRTFMLAKEASLADNNTDVRLIGEKLFHGVSMSERCY_ [SEQ ID NO: 100]
_LMKQVLNFTLEEVLFPQSDRFQPYMQEVVPFLARLSNRLSTCHIEGDDLHIQRNVQKLKDTVKKLGE_
_SGEIKAIGELDLLFMSLRNACI_HDEFERHAEGTFTSDVSSYLEGQAAKEFIAWLVKGRGRR,
wherein:

HDEFERHAEGTFTSDVSSYLEGQAAKEFIAWLVKGRGRR = native GLP-1;

Underlined Text is Flexible Linker;
Text in italics is IL-22 mature polypeptide;
M is an artificial methionine for recombinant expression;
n=1 or more, suitably 1, 2, 3, 4, 5, 6, 7, 8, 9 or 10; and
X is an optional tag (e.g., FLAG$_S$, His$_6$) for purification,
or (s) MXHDEFERHAEGTFTSDVSSYLEGQAAKEFIAWLVKGRG[<u>GGGGSGGGGSGGGGSG</u> [SEQ ID NO: 101]
<u>GGGS</u>]<sub>n</sub>_APISSHCRLDKSNFQQPYITNRTFMLAKEASLADNNTDVRLIGEKLFHGVSMSERCYLMKQ_
_VLNFTLEEVLFPQSDRFQPYMQEVVPFLARLSNRLSTCHIEGDDLHIQRNVQKLKDTVKKLGESGEIK_
_AIGELDLLFMSLRNACI_;

-continued

[SEQ ID NO: 102]
(t) MXHDEFERHAEGTFTSDVSSYLEGQAAKEFIAWLVKGRG[GGGGSGGGS]$_n$APISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI;

[SEQ ID NO: 103]
(u) MXHDEFERHAEGTFTSDVSSYLEGQAAKEFIAWLVKGRG[GGGG]$_n$*APISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI*;

[SEQ ID NO: 104]
(v) MXHDEFERHAEGTFTSDVSSYLEGQAAKEFIAWLVKGRG[GGGGGG]$_n$*APISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI*;

[SEQ ID NO: 105]
(w) MXHDEFERHAEGTFTSDVSSYLEGQAAKEFIAWLVKGRG[GGGGKGGGG]$_n$APISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI;

[SEQ ID NO: 106]
(x) MXHDEFERHAEGTFTSDVSSYLEGQAAKEFIAWLVKGRG[GGGNGSGG]$_n$*APISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI*;

[SEQ ID NO: 107]
(y) MXHDEFERHAEGTFTSDVSSYLEGQAAKEFIAWLVKGRG[GGGGCGGGG]$_n$*APISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI*;

[SEQ ID NO: 108]
(z) MXHDEFERHAEGTFTSDVSSYLEGQAAKEFIAWLVKGRG[GPNGG]$_n$*APISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI*;
and -continued

[SEQ ID NO: 109]
(aa) MXHDEFERHAEGTFTSDVSSYLEGQAAKEFIAWLVKGRGAPISSHCRLDKSNFQQPYI

TNRTFMLAKEASLADNNTDVRLIGEKLFHGVSMSERCYLMKQVLNFTLEEVLFPQSDRFQPYMQEVV

PFLARLSNRLSTCHIEGDDLHIQRNVQKLKDTVKKLGESGEIKAIGELDLLFMSLRNAC,
wherein:

HDEFERHAEGTFTSDVSSYLEGQAAKEFIAWLVKGRG = GLP-1$_{1-37}$;

Underlined Text is Flexible Linker;
Text in italics is IL-22 mature polypeptide;
M is an artificial methionine for recombinant expression;
n=1 or more, suitably 1, 2, 3, 4, 5, 6, 7, 8, 9 or 10; and
X is an optional tag (e.g., FLAG$_S$, His$_6$) for purification,
or

[SEQ ID NO: 110]
(ab) MXAPISSHCRLDKSNFQQPYITNRTFMLAKEASLADNNTDVRLIGEKLFHGVSMSERC

YLMKQVLNFTLEEVLFPQSDRFQPYMQEVVPFLARLSNRLSTCHIEGDDLHIQRNVQKLKDTVKKLGE

SGEIKAIGELDLLFMSLRNACI[GGGGSGGGGSGGGGSGGGGS]$_n$HDEFERHAEGTFTSDVSSYLEG

QAAKEFIAWLVKGRG;

[SEQ ID NO: 111]
(ac) MXAPISSHCRLDKSNFQQPYITNRTFMLAKEASLADNNTDVRLIGEKLFHGVSMSERC

YLMKQVLNFTLEEVLFPQSDRFQPYMQEVVPFLARLSNRLSTCHIEGDDLHIQRNVQKLKDTVKKLGE

SGEIKAIGELDLLFMSLRNACI[GGGSGGGS]$_n$HDEFERHAEGTFTSDVSSYLEGQAAKEFIAWLVKG

RG;

[SEQ ID NO: 112]
(ad) MXAPISSHCRLDKSNFQQPYITNRTFMLAKEASLADNNTDVRLIGEKLFHGVSMSERC

YLMKQVLNFTLEEVLFPQSDRFQPYMQEVVPFLARLSNRLSTCHIEGDDLHIQRNVQKLKDTVKKLGE

SGEIKAIGELDLLFMSLRNACI[GGGG]$_n$HDEFERHAEGTFTSDVSSYLEGQAAKEFIAWLVKGRG;

[SEQ ID NO: 113]
(ae) MXAPISSHCRLDKSNFQQPYITNRTFMLAKEASLADNNTDVRLIGEKLFHGVSMSERC

YLMKQVLNFTLEEVLFPQSDRFQPYMQEVVPFLARLSNRLSTCHIEGDDLHIQRNVQKLKDTVKKLGE

SGEIKAIGELDLLFMSLRNACI[GGGGG]$_n$HDEFERHAEGTFTSDVSSYLEGQAAKEFIAWLVKGRG;

[SEQ ID NO: 114]
(af) MXAPISSHCRLDKSNFQQPYITNRTFMLAKEASLADNNTDVRLIGEKLFHGVSMSERC

YLMKQVLNFTLEEVLFPQSDRFQPYMQEVVPFLARLSNRLSTCHIEGDDLHIQRNVQKLKDTVKKLGE

SGEIKAIGELDLLFMSLRNACI[GGGKGGGG]$_n$HDEFERHAEGTFTSDVSSYLEGQAAKEFIAWLVKG

RG;

[SEQ ID NO: 115]
(ag) MXAPISSHCRLDKSNFQQPYITNRTFMLAKEASLADNNTDVRLIGEKLFHGVSMSERC

YLMKQVLNFTLEEVLFPQSDRFQPYMQEVVPFLARLSNRLSTCHIEGDDLHIQRNVQKLKDTVKKLGE

SGEIKAIGELDLLFMSLRNACI[GGGNGSGG]$_n$HDEFERHAEGTFTSDVSSYLEGQAAKEFIAWLVKG

RG;

[SEQ ID NO: 116]
(ah) MXAPISSHCRLDKSNFQQPYITNRTFMLAKEASLADNNTDVRLIGEKLFHGVSMSERC

YLMKQVLNFTLEEVLFPQSDRFQPYMQEVVPFLARLSNRLSTCHIEGDDLHIQRNVQKLKDTVKKLGE

SGEIKAIGELDLLFMSLRNACI[GGGCGGGG]$_n$HDEFERHAEGTFTSDVSSYLEGQAAKEFIAWLVKG

RG;

-continued

[SEQ ID NO: 117]
(ai) MXAPISSHCRLDKSNFQQPYITNRTFMLAKEASLADNNTDVRLIGEKLFHGVSMSERC
YLMKQVLNFTLEEVLFPQSDRFQPYMQEVVPFLARLSNRLSTCHIEGDDLHIQRNVQKLKDTVKKLGE
SGEIKAIGELDLLFMSLRNACI[GPNGG]$_n$HDEFERHAEGTFTSDVSSYLEGQAAKEFIAWLVKGRG;
and

[SEQ ID NO: 118]
(aj) MXAPISSHCRLDKSNFQQPYITNRTFMLAKEASLADNNTDVRLIGEKLFHGVSMSERC
YLMKQVLNFTLEEVLFPQSDRFQPYMQEVVPFLARLSNRLSTCHIEGDDLHIQRNVQKLKDTVKKLGE
SGEIKAIGELDLLFMSLRNACIHDEFERHAEGTFTSDVSSYLEGQAAKEFIAWLVKGRG,
wherein:

HDEFERHAEGTFTSDVSSYLEGQAAKEFIAWLVKGRG = GLP-1$_{1-37}$;

Underlined Text is Flexible Linker;
Text in italics is IL-22 mature polypeptide;
M is an artificial methionine for recombinant expression;
n=1 or more, suitably 1, 2, 3, 4, 5, 6, 7, 8, 9 or 10; and
X is an optional tag (e.g., FLAG$_S$, His$_6$) for purification,
or

[SEQ ID NO: 119]
(ak) MXHAEGTFTSDVSSYLEGQAAKEFIAWLVKGR[GGGGSGGGGSGGGGSGGGGS]$_n$A
PISSHCRLDKSNFQQPYITNRTFMLAKEASLADNNTDVRLIGEKLFHGVSMSERCYLMKQVLNFTLEE
VLFPQSDRFQPYMQEVVPFLARLSNRLSTCHIEGDDLHIQRNVQKLKDTVKKLGESGEIKAIGELDLL
FMSLRNACI;

[SEQ ID NO: 120]
(al) MXHAEGTFTSDVSSYLEGQAAKEFIAWLVKGR[GGGSGGGS]$_n$APISSHCRLDKSNFQ
QPYITNRTFMLAKEASLADNNTDVRLIGEKLFHGVSMSERCYLMKQVLNFTLEEVLFPQSDRFQPYM
QEWPFLARLSNRLSTCHIEGDDLHIQRNVQKLKDTVKKLGESGEIKAIGELDLLFMSLRNACI;

[SEQ ID NO: 121]
(am) MXHAEGTFTSDVSSYLEGQAAKEFIAWLVKGR[GGGGG]$_n$APISSHCRLDKSNFQQP
YITNRTFMLAKEASLADNNTDVRLIGEKLFHGVSMSERCYLMKQVLNFTLEEVLFPQSDRFQPYMQEV
VPFLARLSNRLSTCHIEGDDLHIQRNVQKLKDTVKKLGESGEIKAIGELDLLFMSLRNACI;

[SEQ ID NO: 122]
(an) MXHAEGTFTSDVSSYLEGQAAKEFIAWLVKGR[GGGGG]$_n$APISSHCRLDKSNFQQPY
ITNRTFMLAKEASLADNNTDVRLIGEKLFHGVSMSERCYLMKQVLNFTLEEVLFPQSDRFQPYMQEV
VPFLARLSNRLSTCHIEGDDLHIQRNVQKLKDTVKKLGESGEIKAIGELDLLFMSLRNACI;

[SEQ ID NO: 123]
(ao) MXHAEGTFTSDVSSYLEGQAAKEFIAWLVKGR[GGGGKGGGG]$_n$APISSHCRLDKSN
FQQPYITNRTFMLAKEASLADNNTDVRLIGEKLFHGVSMSERCYLMKQVLNFTLEEVLFPQSDRFQPY
MQEVVPFLARLSNRLSTCHIEGDDLHIQRNVQKLKDTVKKLGESGEIKAIGELDLLFMSLRNACI;

[SEQ ID NO: 124]
(ap) MXHAEGTFTSDVSSYLEGQAAKEFIAWLVKGR[GGGNGSGG]$_n$APISSHCRLDKSNF
QQPYITNRTFMLAKEASLADNNTDVRLIGEKLFHGVSMSERCYLMKQVLNFTLEEVLFPQSDRFQPY
MQEVVPFLARLSNRLSTCHIEGDDLHIQRNVQKLKDTVKKLGESGEIKAIGELDLLFMSLRNACI;

[SEQ ID NO: 125]
(aq) MXHAEGTFTSDVSSYLEGQAAKEFIAWLVKGR[GGGCGGGG]$_n$APISSHCRLDKSNF
QQPYITNRTFMLAKEASLADNNTDVRLIGEKLFHGVSMSERCYLMKQVLNFTLEEVLFPQSDRFQPY
MQEVVPFLARLSNRLSTCHIEGDDLHIQRNVQKLKDTVKKLGESGEIKAIGELDLLFMSLRNACI;

-continued

[SEQ ID NO: 126]
(ar) MXHAEGTFTSDVSSYLEGQAAKEFIAWLVKGR[GPNGG]$_n$*APISSHCRLDKSNFQQPYI TNRTFMLAKEASLADNNTDVRLIGEKLFHGVSMSERCYLMKQVLNFTLEEVLFPQSDRFQPYMQEVV PFLARLSNRLSTCHIEGDDLHIQRNVQKLKDTVKKLGESGEIKAIGELDLLFMSLRNACI*;
and

[SEQ ID NO: 127]
(as) MXHAEGTFTSDVSSYLEGQAAKEFIAWLVKGR*APISSHCRLDKSNFQQPYITNRTFML AKEASLADNNTDVRLIGEKLFHGVSMSERCYLMKQVLNFTLEEVLFPQSDRFQPYMQEVVPFLARLS NRLSTCHIEGDDLHIQRNVQKLKDTVKKLGESGEIKAIGELDLLFMSLRNACI*,
wherein:

HAEGTFTSDVSSYLEGQAAKEFIAWLVKGR = GLP-1$_{7-36}$;

Underlined Text is Flexible Linker;
Text in italics is IL-22 mature polypeptide;
M is an artificial methionine for recombinant expression;
n=1 or more, suitably 1, 2, 3, 4, 5, 6, 7, 8, 9 or 10; and
X is an optional tag (e.g., FLAG$_S$, His$_6$) for purification,
or

[SEQ ID NO: 128]
(at) MXHAPISSHCRLDKSNFQQPYITNRTFMLAKEASLADNNTDVRLIGEKLFHGVSMSER CYLMKQVLNFTLEEVLFPQSDRFQPYMQEVVPFLARLSNRLSTCHIEGDDLHIQRNVQKLKDTVKKL GESGEIKAIGELDLLFMSLRNACI[GGGGSGGGGSGGGGSGGGGS]$_n$HAEGTFTSDVSSYLEGQAA KEFIAWLVKGR;

[SEQ ID NO: 129]
(au) MXAPISSHCRLDKSNFQQPYITNRTFMLAKEASLADNNTDVRLIGEKLFHGVSMSERC YLMKQVLNFTLEEVLFPQSDRFQPYMQEVVPFLARLSNRLSTCHIEGDDLHIQRNVQKLKDTVKKLGE SGEIKAIGELDLLFMSLRNACI[GGGSGGGS]$_n$HAEGTFTSDVSSYLEGQAAKEFIAWLVKGR;

[SEQ ID NO: 130]
(av) MXAPISSHCRLDKSNFQQPYITNRTFMLAKEASLADNNTDVRLIGEKLFHGVSMSERC YLMKQVLNFTLEEVLFPQSDRFQPYMQEVVPFLARLSNRLSTCHIEGDDLHIQRNVQKLKDTVKKLGE SGEIKAIGELDLLFMSLRNACI[GGGG]$_n$HAEGTFTSDVSSYLEGQAAKEFIAWLVKGR;

[SEQ ID NO: 131]
(aw) MXAPISSHCRLDKSNFQQPYITNRTFMLAKEASLADNNTDVRLIGEKLFHGVSMSERC YLMKQVLNFTLEEVLFPQSDRFQPYMQEVVPFLARLSNRLSTCHIEGDDLHIQRNVQKLKDTVKKLGE SGEIKAIGELDLLFMSLRNACI[GGGGG]$_n$HAEGTFTSDVSSYLEGQAAKEFIAWLVKGR;

[SEQ ID NO: 132]
(ax) MXAPISSHCRLDKSNFQQPYITNRTFMLAKEASLADNNTDVRLIGEKLFHGVSMSERC YLMKQVLNFTLEEVLFPQSDRFQPYMQEVVPFLARLSNRLSTCHIEGDDLHIQRNVQKLKDTVKKLGE SGEIKAIGELDLLFMSLRNACI[GGGKGGGG]$_n$HAEGTFTSDVSSYLEGQAAKEFIAWLVKGR;

[SEQ ID NO: 133]
(ay) MXAPISSHCRLDKSNFQQPYITNRTFMLAKEASLADNNTDVRLIGEKLFHGVSMSERC YLMKQVLNFTLEEVLFPQSDRFQPYMQEVVPFLARLSNRLSTCHIEGDDLHIQRNVQKLKDTVKKLGE SGEIKAIGELDLLFMSLRNACI[GGGNGSGG]$_n$HAEGTFTSDVSSYLEGQAAKEFIAWLVKGR;

[SEQ ID NO: 134]
(az) MXAPISSHCRLDKSNFQQPYITNRTFMLAKEASLADNNTDVRLIGEKLFHGVSMSERC YLMKQVLNFTLEEVLFPQSDRFQPYMQEVVPFLARLSNRLSTCHIEGDDLHIQRNVQKLKDTVKKLGE SGEIKAIGELDLLFMSLRNACI[GGGCGGGG]$_n$HAEGTFTSDVSSYLEGQAAKEFIAWLVKGR;

-continued

[SEQ ID NO: 135]
(aaa) MXAPISSHCRLDKSNFQQPYITNRTFMLAKEASLADNNTDVRLIGEKLFHGVSMSER

CYLMKQVLNFTLEEVLFPQSDRFQPYMQEVVPFLARLSNRLSTCHIEGDDLHIQRNVQKLKDTVKKL

GESGEIKAIGELDLLFMSLRNACI[GPNGG]<sub>n</sub>HAEGTFTSDVSSYLEGQAAKEFIAWLVKGR;
and

[SEQ ID NO: 136]
(aab) MXAPISSHCRLDKSNFQQPYITNRTFMLAKEASLADNNTDVRLIGEKLFHGVSMSER

CYLMKQVLNFTLEEVLFPQSDRFQPYMQEVVPFLARLSNRLSTCHIEGDDLHIQRNVQKLKDTVKKL

GESGEIKAIGELDLLFMSLRNACIHAEGTFTSDVSSYLEGQAAKEFIAWLVKGR,
wherein:

HAEGTFTSDVSSYLEGQAAKEFIAWLVKGR = GLP-1$_{7-36}$;

Underlined Text is Flexible Linker;
Text in italics is IL-22 mature polypeptide;
M is an artificial methionine for recombinant expression;
n=1 or more, suitably 1, 2, 3, 4, 5, 6, 7, 8, 9 or 10; and
X is an optional tag (e.g., FLAG$_S$, His$_6$) for purification.

In other embodiments, the chimeric constructs comprise alternative GLP-1 peptide analogs substituted for the peptide analogs defined above, illustrative examples of which include:

(1) HAEGTFTSDVSSYLEGQAAKEFIAWLVKGRG [SEQ ID NO: 16], which corresponds to the amino acid sequence of GLP-1$_{7-37}$, (2) MKSIYFVAGLFVMLVQGSWQRSLQDTEEKSRSFSASQADPLSDPDQMNEDKRHSQGT FTSDYSKYLDSRRAQDFVQWLMNTKRNRNNIAKRHDEFERHAEGTFTSDVSSYLEGQAAKEFIAWL VKGRGRRDFPEEVAIVEELGRRHADGSFSDEMNTILDNLAARDFINWLIQTKITDRK [SEQ ID NO: 18], which corresponds to the amino acid sequence of glucagon preproprotein, (3) RSLQDTEEKSRSFSASQADPLSDPDQMNEDKRHSQGTFTSDYSKYLDSRRAQDFVQW LMNTKRNRNNIAKRHDEFERHAEGTFTSDVSSYLEGQAAKEFIAWLVKGRGRRDFPEEVAIVEELGR RHADGSFSDEMNTILDNLAARDFINWLIQTKITDRK [SEQ ID NO: 20], which corresponds to the amino acid sequence of glucagon proprotein, (4) HGEGTFTSDLSKQMEEEAVRLFIEWLKNGGPSSGAPPPS [SEQ ID NO: 22], which corresponds to the amino acid sequence of Exendin-4, (5) MVATKTFALLLLSLFLAVGLGEKKEGHFSALPSLPVGSHAKVSSPQPRGPRYAEGTFISD YSIAMDKIHQQDFVNWLLAQKGKKNDWKHNITQREARALELASQANRKEEEAVEPQSSPAKNPSD EDLLRDLLIQELLACLLDQTNLCRLRSR [SEQ ID NO: 24], which corresponds to the amino acid sequence of gastric inhibitory polypeptide preproprotein, and (6) a GLP-1 analog selected from HX$_8$EGTFTSDVSSYLEGQAAKEFIAWLVKGGG [SEQ ID NO: 30], wherein X$_8$ is selected from G or V; HX$_8$EGTFTSDVSSYLEGQAAKEFIAWLKNGGG [SEQ ID NO: 31], wherein X$_8$ is selected from G or V; HX$_8$EGTFTSDVSSYLEGQAAKEFIAWLVKGGP [SEQ ID NO: 32], wherein X$_8$ is selected from G or V; HX$_8$EGTFTSDVSSYLEGQAAKEFIAWLKNGGP [SEQ ID NO: 33], wherein X$_8$ is selected from G or V; HX$_8$EGTFTSDVSSYLEGQAAKEFIAWLVKGG [SEQ ID NO: 34], wherein X$_8$ is selected from G or V; or HX$_8$EGTFTSDVSSYLEGQAAKEFIAWLKNGG [SEQ ID NO: 35], wherein X$_8$ is selected from G or V, wherein the GLP-1 analog is fused to the Fc portion of an immunoglobulin comprising the sequence AESKYGPPCPPCPAPX$_{16}$X$_{17}$X$_{18}$GGPSVFLFPPKPKDTLMISRTPEVTCVVVDVSQEDPEVQFNWYVD GVEVHNAKTKPREEQFX$_{80}$STYRVVSVLTVLHQDWLNGKEYKCKVSNKGLPSSIEKTISKAKGQPREP QVYTLPPSQEEMTKNQVSLTCLVKGFYPSDIAVEWESNGQPENNYKTTPPVLDSDGSFFLYSRLTVD KSRWQEGNVFSCSVMHEALHNHYTQKSLSLSLGX$_{230}$ [SEQ ID NO: 36], wherein X$_{16}$ is selected from P or E, X$_{17}$ is selected from F, V or A, X$_{18}$ is selected from L, E or A, and X$_{230}$ is K or is absent.

In other embodiments, the GLP-1R targeting agent of the chimeric construct is an antigen-binding molecule and non-limiting constructs of this type include:

[SEQ ID NO: 137]
(i) MXQIVLTQSPAIMSASPGEKVTMTCSASSRVTYMHWYQQRSGTSPKRWIYDTSKLASG

VPARFSGSGSGTSYSLTISSMEAEDAATYYCQQWGNNPQYTFGGGTRLEIKRGGGGSGGGGSGGG

GSGGGGSQVTLKESGPGILQPSQTLSLTCSFSGFSLSTSGTGVGWIRQPSGKGLEWLSHIWWDDV

KRYNPALKSRLTISRDTSYSQVFLRIASVDTADTATYYCARILDGTGPMDYWGQGTSVTVSS[GGGG

SGGGGSGGGGSGGGGS]<sub>n</sub>APISSHCRLDKSNFQQPYITNRTFMLAKEASLADNNTDVRLIGEKLFH

GVSMSERCYLMKQVLNFTLEEVLFPQSDRFQPYMQEWPFLARLSNRLSTCHIEGDDLHIQRNVQKL

KDTVKKLGESGEIKAIGELDLLFMSLRNACI;

[SEQ ID NO: 138]
(ii) MXQIVLTQSPAIMSASPGEKVTMTCSASSRVTYMHWYQQRSGTSPKRWIYDTSKLAS

GVPARFSGSGSGTSYSLTISSMEAEDAATYYCQQWGNNPQYTFGGGTRLEIKRGGGGSGGGGSGG

GGSGGGGSQVTLKESGPGILQPSQTLSLTCSFSGFSLSTSGTGVGWIRQPSGKGLEWLSHIWWDD
VKRYNPALKSRLTISRDTSYSQVFLRIASVDTADTATYYCARILDGTPMDYWGQGTSVTVSS[GGG
SGGGS]<sub>n</sub>APISSHCRLDKSNFQQPYITNRTFMLAKEASLADNNTDVRLIGEKLFHGVSMSERCYLMK
QVLNFTLEEVLFPQSDRFQPYMQEWPFLARLSNRLSTCHIEGDDLHIQRNVQKLKDTVKKLGESGEI
KAIGELDLLFMSLRNACI;

[SEQ ID NO: 139]
(iii) MXQIVLTQSPAIMSASPGEKVTMTCSASSRVTYMHWYQQRSGTSPKRWIYDTSKLAS
GVPARFSGSGSGTSYSLTISSMEAEDAATYYCQQWGNNPQYTFGGGTRLEIKRGGGGSGGGGSGG
GGSGGGGSQVTLKESGPGILQPSQTLSLTCSFSGFSLSTSGTGVGWIRQPSGKGLEWLSHIWWDD
VKRYNPALKSRLTISRDTSYSQVFLRIASVDTADTATYYCARILDGTPMDYWGQGTSVTVSS[GGG
G]<sub>n</sub>APISSHCRLDKSNFQQPYITNRTFMLAKEASLADNNTDVRLIGEKLFHGVSMSERCYLMKQVLNF
TLEEVLFPQSDRFQPYMQEWPFLARLSNRLSTCHIEGDDLHIQRNVQKLKDTVKKLGESGEIKAIGE
LDLLFMSLRNACI;

[SEQ ID NO: 140]
(iv) MXQIVLTQSPAIMSASPGEKVTMTCSASSRVTYMHWYQQRSGTSPKRWIYDTSKLAS
GVPARFSGSGSGTSYSLTISSMEAEDAATYYCQQWGNNPQYTFGGGTRLEIKRGGGGSGGGGSGG
GGSGGGGSQVTLKESGPGILQPSQTLSLTCSFSGFSLSTSGTGVGWIRQPSGKGLEWLSHIWWDD
VKRYNPALKSRLTISRDTSYSQVFLRIASVDTADTATYYCARILDGTPMDYWGQGTSVTVSS[GGG
GG]<sub>n</sub>APISSHCRLDKSNFQQPYITNRTFMLAKEASLADNNTDVRLIGEKLFHGVSMSERCYLMKQVLN
FTLEEVLFPQSDRFQPYMQEVVPFLARLSNRLSTCHIEGDDLHIQRNVQKLKDTVKKLGESGEIKAIG
ELDLLFMSLRNACI;

[SEQ ID NO: 141]
(v) MXQIVLTQSPAIMSASPGEKVTMTCSASSRVTYMHWYQQRSGTSPKRWIYDTSKLAS
GVPARFSGSGSGTSYSLTISSMEAEDAATYYCQQWGNNPQYTFGGGTRLEIKRGGGGSGGGGSGG
GGSGGGGSQVTLKESGPGILQPSQTLSLTCSFSGFSLSTSGTGVGWIRQPSGKGLEWLSHIWWDD
VKRYNPALKSRLTISRDTSYSQVFLRIASVDTADTATYYCARILDGTPMDYWGQGTSVTVSS[GGG
GKGGGG]<sub>n</sub>APISSHCRLDKSNFQQPYITNRTFMLAKEASLADNNTDVRLIGEKLFHGVSMSERCYLM
KQVLNFTLEEVLFPQSDRFQPYMQEVVPFLARLSNRLSTCHIEGDDLHIQRNVQKLKDTVKKLGESG
EIKAIGELDLLFMSLRNACI;

[SEQ ID NO: 142]
(vi) MXQIVLTQSPAIMSASPGEKVTMTCSASSRVTYMHWYQQRSGTSPKRWIYDTSKLAS
GVPARFSGSGSGTSYSLTISSMEAEDAATYYCQQWGNNPQYTFGGGTRLEIKRGGGGSGGGGSGG
GGSGGGGSQVTLKESGPGILQPSQTLSLTCSFSGFSLSTSGTGVGWIRQPSGKGLEWLSHIWWDD
VKRYNPALKSRLTISRDTSYSQVFLRIASVDTADTATYYCARILDGTPMDYWGQGTSVTVSS[GGG
NGSGG]<sub>n</sub>APISSHCRLDKSNFQQPYITNRTFMLAKEASLADNNTDVRLIGEKLFHGVSMSERCYLMK
QVLNFTLEEVLFPQSDRFQPYMQEWPFLARLSNRLSTCHIEGDDLHIQRNVQKLKDTVKKLGESGEI
KAIGELDLLFMSLRNACI;

[SEQ ID NO: 143]
(vii) MXQIVLTQSPAIMSASPGEKVTMTCSASSRVTYMHWYQQRSGTSPKRWIYDTSKLAS
GVPARFSGSGSGTSYSLTISSMEAEDAATYYCQQWGNNPQYTFGGGTRLEIKRGGGGSGGGGSGG
GGSGGGGSQVTLKESGPGILQPSQTLSLTCSFSGFSLSTSGTGVGWIRQPSGKGLEWLSHIWWDD
VKRYNPALKSRLTISRDTSYSQVFLRIASVDTADTATYYCARILDGTPMDYWGQGTSVTVSS[GGG
CGGGG]<sub>n</sub>APISSHCRLDKSNFQQPYITNRTFMLAKEASLADNNTDVRLIGEKLFHGVSMSERCYLMK -continued

*QVLNFTLEEVLFPQSDRFQPYMQEWPFLARLSNRLSTCHIEGDDLHIQRNVQKLKDTVKKLGESGEI*

*KAIGELDLLFMSLRNACI*;

[SEQ ID NO: 144]
(viii) MXQIVLTQSPAIMSASPGEKVTMTCSASSRVTYMHWYQQRSGTSPKRWIYDTSKLA

SGVPARFSGSGSGTSYSLTISSMEAEDAATYYCQQWGNNPQYTFGGGTRLEIKRGGGGSGGGGSG

GGGSGGGGSQVTLKESGPGILQPSQTLSLTCSFSGFSLSTSGTGVGWIRQPSGKGLEWLSHIWWD

DVKRYNPALKSRLTISRDTSYSQVFLRIASVDTADTATYYCARILDGTGPMDYWGQGTSVTVSS[GP

NGG]<sub>n</sub>*APISSHCRLDKSNFQQPYITNRTFMLAKEASLADNNTDVRLIGEKLFHGVSMSERCYLMKQVL*

*NFTLEEVLFPQSDRFQPYMQEWPFLARLSNRLSTCHIEGDDLHIQRNVQKLKDTVKKLGESGEIKAI*

*GELDLLFMSLRNACI*;
and

[SEQ ID NO: 145]
(ix) MXQIVLTQSPAIMSASPGEKVTMTCSASSRVTYMHWYQQRSGTSPKRWIYDTSKLAS

GVPARFSGSGSGTSYSLTISSMEAEDAATYYCQQWGNNPQYTFGGGTRLEIKRGGGGSGGGGSGG

GGSGGGGSQVTLKESGPGILQPSQTLSLTCSFSGFSLSTSGTGVGWIRQPSGKGLEWLSHIWWDD

VKRYNPALKSRLTISRDTSYSQVFLRIASVDTADTATYYCARILDGTGPMDYWGQGTSVTVSS*APISS*

*HCRLDKSNFQQPYITNRTFMLAKEASLADNNTDVRLIGEKLFHGVSMSERCYLMKQVLNFTLEEVLFP*

*QSDRFQPYMQEVVPFLARLSNRLSTCHIEGDDLHIQRNVQKLKDTVKKLGESGEIKAIGELDLLFMSL*

*RNACI*,
wherein:

[SEQ ID NO: 45]
QIVLTQSPAIMSASPGEKVTMTCSASSRVTYMHWYQQRSGTSPKRWIYDTSKLASGVPARF

SGSGSGTSYSLTISSMEAEDAATYYCQQWGNNPQYTFGGGTRLEIKRGGGGSGGGGSGGGGSGG

GGSQVTLKESGPGILQPSQTLSLTCSFSGFSLSTSGTGVGWIRQPSGKGLEWLSHIWWDDVKRYNP

ALKSRLTISRDTSYSQVFLRIASVDTADTATYYCARILDGTGPMDYWGQGTSVTVSS =

GLP-1R agonist scFv;

40

Underlined Text is Flexible Linker;
Text in italics is IL-22 mature polypeptide;
M is an artificial methionine for recombinant expression;
n=1 or more, suitably 1, 2, 3, 4, 5, 6, 7, 8, 9 or 10; and
X is an optional tag (e.g., FLAG$_S$, His$_6$) for purification,
or

[SEQ ID NO: 146]
(x) MXH*APISSHCRLDKSNFQQPYITNRTFMLAKEASLADNNTDVRLIGEKLFHGVSMSERC*

*YLMKQVLNFTLEEVLFPQSDRFQPYMQEWPFLARLSNRLSTCHIEGDDLHIQRNVQKLKDTVKKLGE*

*SGEIKAIGELDLLFMSLRNACI*[GGGGSGGGGSGGGGSGGGGS]<sub>2</sub>QIVLTQSPAIMSASPGEKVTMT

CSASSRVTYMHWYQQRSGTSPKRWIYDTSKLASGVPARFSGSGSGTSYSLTISSMEAEDAATYYCQ

QWGNNPQYTFGGGTRLEIKRGGGGSGGGGSGGGGSGGGGSQVTLKESGPGILQPSQTLSLTCSFS

GFSLSTSGTGVGWIRQPSGKGLEWLSHIWWDDVKRYNPALKSRLTISRDTSYSQVFLRIASVDTAD

TATYYCARILDGTGPMDYWGQGTSVTVSS;

[SEQ ID NO: 147]
(xi) MX*APISSHCRLDKSNFQQPYITNRTFMLAKEASLADNNTDVRLIGEKLFHGVSMSERC*

*YLMKQVLNFTLEEVLFPQSDRFQPYMQEVVPFLARLSNRLSTCHIEGDDLHIQRNVQKLKDTVKKLGE*

*SGEIKAIGELDLLFMSLRNACI*[GGGSGGGS]<sub>2</sub>QIVLTQSPAIMSASPGEKVTMTCSASSRVTYMHWY

QQRSGTSPKRWIYDTSKLASGVPARFSGSGSGTSYSLTISSMEAEDAATYYCQQWGNNPQYTFGG

```
                                                       [SEQ ID NO: 147]
GTRLEIKRGGGGSGGGGSGGGGSGGGGSQVTLKESGPGILQPSQTLSLTCSFSGFSLSTSGTGVG

WIRQPSGKGLEWLSHIWWDDVKRYNPALKSRLTISRDTSYSQVFLRIASVDTADTATYYCARILDGT

GPMDYWGQGTSVTVSS;

[SEQ ID NO: 148]
(xii) MXAPISSHCRLDKSNFQQPYITNRTFMLAKEASLADNNTDVRLIGEKLFHGVSMSERC

YLMKQVLNFTLEEVLFPQSDRFQPYMQEWPFLARLSNRLSTCHIEGDDLHIQRNVQKLKDTVKKLGE

SGEIKAIGELDLLFMSLRNACI[GGGG]ₙQIVLTQSPAIMSASPGEKVTMTCSASSRVTYMHWYQQRS

GTSPKRWIYDTSKLASGVPARFSGSGSGTSYSLTISSMEAEDAATYYCQQWGNNPQYTFGGGTRLE

IKRGGGGSGGGGSGGGGSGGGGSQVTLKESGPGILQPSQTLSLTCSFSGFSLSTSGTGVGWIRQP

SGKGLEWLSHIWWDDVKRYNPALKSRLTISRDTSYSQVFLRIASVDTADTATYYCARILDGTGPMDY

WGQGTSVTVSS;

[SEQ ID NO: 149]
(xiii) MXAPISSHCRLDKSNFQQPYITNRTFMLAKEASLADNNTDVRLIGEKLFHGVSMSERC

YLMKQVLNFTLEEVLFPQSDRFQPYMQEVVPFLARLSNRLSTCHIEGDDLHIQRNVQKLKDTVKKLGE

SGEIKAIGELDLLFMSLRNACI[GGGGG]ₙQIVLTQSPAIMSASPGEKVTMTCSASSRVTYMHWYQQ

RSGTSPKRWIYDTSKLASGVPARFSGSGSGTSYSLTISSMEAEDAATYYCQQWGNNPQYTFGGGTR

LEIKRGGGGSGGGGSGGGGSGGGGSQVTLKESGPGILQPSQTLSLTCSFSGFSLSTSGTGVGWIR

QPSGKGLEWLSHIWWDDVKRYNPALKSRLTISRDTSYSQVFLRIASVDTADTATYYCARILDGTGPM

DYWGQGTSVTVSS;

[SEQ ID NO: 150]
(xiv) MXAPISSHCRLDKSNFQQPYITNRTFMLAKEASLADNNTDVRLIGEKLFHGVSMSER

CYLMKQVLNFTLEEVLFPQSDRFQPYMQEWPFLARLSNRLSTCHIEGDDLHIQRNVQKLKDTVKKL

GESGEIKAIGELDLLFMSLRNACI[GGGKGGGG]ₙQIVLTQSPAIMSASPGEKVTMTCSASSRVTYMH

WYQQRSGTSPKRWIYDTSKLASGVPARFSGSGSGTSYSLTISSMEAEDAATYYCQQWGNNPQYTF

GGGTRLEIKRGGGGSGGGGSGGGGSGGGGSQVTLKESGPGILQPSQTLSLTCSFSGFSLSTSGTG

VGWIRQPSGKGLEWLSHIWWDDVKRYNPALKSRLTISRDTSYSQVFLRIASVDTADTATYYCARILD

GTGPMDYWGQGTSVTVSS;

[SEQ ID NO: 151]
(xv) MXAPISSHCRLDKSNFQQPYITNRTFMLAKEASLADNNTDVRLIGEKLFHGVSMSERC

YLMKQVLNFTLEEVLFPQSDRFQPYMQEVVPFLARLSNRLSTCHIEGDDLHIQRNVQKLKDTVKKLGE

SGEIKAIGELDLLFMSLRNACI[GGGNGSGG]ₙQIVLTQSPAIMSASPGEKVTMTCSASSRVTYMHWY

QQRSGTSPKRWIYDTSKLASGVPARFSGSGSGTSYSLTISSMEAEDAATYYCQQWGNNPQYTFGG

GTRLEIKRGGGGSGGGGSGGGGSGGGGSQVTLKESGPGILQPSQTLSLTCSFSGFSLSTSGTGVG

WIRQPSGKGLEWLSHIWWDDVKRYNPALKSRLTISRDTSYSQVFLRIASVDTADTATYYCARILDGT

GPMDYWGQGTSVTVSS;

[SEQ ID NO: 152]
(xvii) MXAPISSHCRLDKSNFQQPYITNRTFMLAKEASLADNNTDVRLIGEKLFHGVSMSER

CYLMKQVLNFTLEEVLFPQSDRFQPYMQEVVPFLARLSNRLSTCHIEGDDLHIQRNVQKLKDTVKKL

GESGEIKAIGELDLLFMSLRNACI[GGGCGGGG]ₙQIVLTQSPAIMSASPGEKVTMTCSASSRVTYMH

WYQQRSGTSPKRWIYDTSKLASGVPARFSGSGSGTSYSLTISSMEAEDAATYYCQQWGNNPQYTF

GGGTRLEIKRGGGGSGGGGSGGGGSGGGGSQVTLKESGPGILQPSQTLSLTCSFSGFSLSTSGTG

VGWIRQPSGKGLEWLSHIWWDDVKRYNPALKSRLTISRDTSYSQVFLRIASVDTADTATYYCARILD

GTGPMDYWGQGTSVTVSS;
```

[SEQ ID NO: 153]

(xviii) MX_APISSHCRLDKSNFQQPYITNRTFMLAKEASLADNNTDVRLIGEKLFHGVSMSER_
_CYLMKQVLNFTLEEVLFPQSDRFQPYMQEWPFLARLSNRLSTCHIEGDDLHIQRNVQKLKDTVKKL_
_GESGEIKAIGELDLLFMSLRNACI_[GPNGG]$_2$QIVLTQSPAIMSASPGEKVTMTCSASSRVTYMHWYQ
QRSGTSPKRWIYDTSKLASGVPARFSGSGSGTSYSLTISSMEAEDAATYYCQQWGNNPQYTFGGGT
RLEIKRGGGGSGGGGSGGGGSGGGGSQVTLKESGPGILQPSQTLSLTCSFSGFSLSTSGTGVGWI
RQPSGKGLEWLSHIWWDDVKRYNPALKSRLTISRDTSYSQVFLRIASVDTADTATYYCARILDGTGP
MDYWGQGTSVTVSS;
and

[SEQ ID NO: 154]

(xix) MX_APISSHCRLDKSNFQQPYITNRTFMLAKEASLADNNTDVRLIGEKLFHGVSMSER_
_CYLMKQVLNFTLEEVLFPQSDRFQPYMQEWPFLARLSNRLSTCHIEGDDLHIQRNVQKLKDTVKKL_
_GESGEIKAIGELDLLFMSLRNACI_QIVLTQSPAIMSASPGEKVTMTCSASSRVTYMHWYQQRSGTSP
KRWIYDTSKLASGVPARFSGSGSGTSYSLTISSMEAEDAATYYCQQWGNNPQYTFGGGTRLEIKRG
GGGSGGGGSGGGGSGGGGSQVTLKESGPGILQPSQTLSLTCSFSGFSLSTSGTGVGWIRQPSGKG
LEWLSHIWWDDVKRYNPALKSRLTISRDTSYSQVFLRIASVDTADTATYYCARILDGTGPMDYWGQ
GTSVTVSS,
wherein:

[SEQ ID NO: 45]

QIVLTQSPAIMSASPGEKVTMTCSASSRVTYMHWYQQRSGTSPKRWIYDTSKLASGVPARF
SGSGSGTSYSLTISSMEAEDAATYYCQQWGNNPQYTFGGGTRLEIKRGGGGSGGGGSGGGGSGG
GGSQVTLKESGPGILQPSQTLSLTCSFSGFSLSTSGTGVGWIRQPSGKGLEWLSHIWWDDVKRYNP
ALKSRLTISRDTSYSQVFLRIASVDTADTATYYCARILDGTGPMDYWGQGTSVTVSS =
GLP-1R agonist scFv, Underlined Text is Flexible Linker;
Text in italics is IL-22 mature polypeptide;
M is an artificial methionine for recombinant expression;
n=1 or more, suitably 1, 2, 3, 4, 5, 6, 7, 8, 9 or 10; and
X is an optional tag (e.g., FLAG$_S$, His$_6$) for purification.

In other embodiments, the OER stress inhibitor is an IL-22 polypeptide and the targeting agent is an antigen-binding molecule that is immuno-interactive with a β-cell surface binding protein as taught for example in WO 2010/096930. Non-limiting examples of constructs of this type include:

[SEQ ID NO: 155]

(i) MAMAEVQLLESGGGLVQPGGSLRLSCAASGFTFSSYAMSWVRQAPGKGLEWVSSITAE
GTHTWYADSVKGRFTISRDNSKNTLYLQMNSLRAEDTAVYYCAKTSYRFDYWGQGTLVTVSSGGG
GSGGGGSGGGGSTDIQMTQSPSSLSASVGDRVTITCRASQSISSYLNWYQQKPGKAPKLLIYKASR
LQSGVPSRFSGSGSGTDFTLTISSLQPEDFATYYCQQKWDPPRTFGQGTKVEIKRAAAHHHHHHGA
AEQKLISEEDLN[GGGGSGGGGSGGGGSGGGGS]$_r$_APISSHCRLDKSNFQQPYITNRTFMLAKEASL_
_ADNNTDVRLIGEKLFHGVSMSERCYLMKQVLNFTLEEVLFPQSDRFQPYMQEWPFLARLSNRLSTC_
_HIEGDDLHIQRNVQKLKDTVKKLGESGEIKAIGELDLLFMSLRNACI_;

[SEQ ID NO: 156]

(ii) MAMAEVQLLESGGGLVQPGGSLRLSCAASGFTFSSYAMSWVRQAPGKGLEWVSSITA
EGTHTWYADSVKGRFTISRDNSKNTLYLQMNSLRAEDTAVYYCAKTSYRFDYWGQGTLVTVSSGG
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHHG
AAEQKLISEEDLN[GGGSGGGS]$_r$_APISSHCRLDKSNFQQPYITNRTFMLAKEASLADNNTDVRLIGE_

-continued

KLFHGVSMSERCYLMKQVLNFTLEEVLFPQSDRFQPYMQEVVPFLARLSNRLSTCHIEGDDLHIQRN
VQKLKDTVKKLGESGEIKAIGELDLLFMSLRNACI;

[SEQ ID NO: 157]
(iii) MAMAEVQLLESGGGLVQPGGSLRLSCAASGFTFSSYAMSWVRQAPGKGLEWVSSITA
EGTHTWYADSVKGRFTISRDNSKNTLYLQMNSLRAEDTAVYYCAKTSYRFDYWGQGTLVTVSSGG
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHHG
AAEQKLISEEDLN[GGGG]<sub>n</sub>*APISSHCRLDKSNFQQPYITNRTFMLAKEASLADNNTDVRLIGEKLFH
GVSMSERCYLMKQVLNFTLEEVLFPQSDRFQPYMQEWPFLARLSNRLSTCHIEGDDLHIQRNVQKL
KDTVKKLGESGEIKAIGELDLLFMSLRNACI*;

[SEQ ID NO: 158]
(iv) MAMAEVQLLESGGGLVQPGGSLRLSCAASGFTFSSYAMSWVRQAPGKGLEWVSSITA
EGTHTWYADSVKGRFTISRDNSKNTLYLQMNSLRAEDTAVYYCAKTSYRFDYWGQGTLVTVSSGG
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHHG
AAEQKLISEEDLN[GGGGG]<sub>n</sub>*APISSHCRLDKSNFQQPYITNRTFMLAKEASLADNNTDVRLIGEKLF
HGVSMSERCYLMKQVLNFTLEEVLFPQSDRFQPYMQEVVPFLARLSNRLSTCHIEGDDLHIQRNVQK
LKDTVKKLGESGEIKAIGELDLLFMSLRNACI*;

[SEQ ID NO: 159]
(v) MAMAEVQLLESGGGLVQPGGSLRLSCAASGFTFSSYAMSWVRQAPGKGLEWVSSITA
EGTHTWYADSVKGRFTISRDNSKNTLYLQMNSLRAEDTAVYYCAKTSYRFDYWGQGTLVTVSSGG
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHHG
AAEQKLISEEDLN[GGGGKGGGG]<sub>n</sub>*APISSHCRLDKSNFQQPYITNRTFMLAKEASLADNNTDVRLIG
EKLFHGVSMSERCYLMKQVLNFTLEEVLFPQSDRFQPYMQEVVPFLARLSNRLSTCHIEGDDLHIQR
NVQKLKDTVKKLGESGEIKAIGELDLLFMSLRNACI*;

[SEQ ID NO: 160]
(vi) MAMAEVQLLESGGGLVQPGGSLRLSCAASGFTFSSYAMSWVRQAPGKGLEWVSSITA
EGTHTWYADSVKGRFTISRDNSKNTLYLQMNSLRAEDTAVYYCAKTSYRFDYWGQGTLVTVSSGG
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHHG
AAEQKLISEEDLN[GGGNGSGG]<sub>n</sub>*APISSHCRLDKSNFQQPYITNRTFMLAKEASLADNNTDVRLIGE
KLFHGVSMSERCYLMKQVLNFTLEEVLFPQSDRFQPYMQEVVPFLARLSNRLSTCHIEGDDLHIQRN
VQKLKDTVKKLGESGEIKAIGELDLLFMSLRNACI*;

[SEQ ID NO: 161]
(vii) MAMAEVQLLESGGGLVQPGGSLRLSCAASGFTFSSYAMSWVRQAPGKGLEWVSSIT
AEGTHTWYADSVKGRFTISRDNSKNTLYLQMNSLRAEDTAVYYCAKTSYRFDYWGQGTLVTVSSGG
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHHG
AAEQKLISEEDLN[GGGCGGGG]<sub>n</sub>*APISSHCRLDKSNFQQPYITNRTFMLAKEASLADNNTDVRLIGE
KLFHGVSMSERCYLMKQVLNFTLEEVLFPQSDRFQPYMQEVVPFLARLSNRLSTCHIEGDDLHIQRN
VQKLKDTVKKLGESGEIKAIGELDLLFMSLRNACI*;

-continued (viii) MAMAEVQLLESGGGLVQPGGSLRLSCAASGFTFSSYAMSWVRQAPGKGLEWVSSIT [SEQ ID NO: 162]
AEGTHTWYADSVKGRFTISRDNSKNTLYLQMNSLRAEDTAVYYCAKTSYRFDYWGQGTLVTVSSGG
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHHG
AAEQKLISEEDLN[GPNGG]<sub>n</sub>*APISSHCRLDKSNFQQPYITNRTFMLAKEASLADNNTDVRLIGEKLFH*
*GVSMSERCYLMKQVLNFTLEEVLFPQSDRFQPYMQEWPFLARLSNRLSTCHIEGDDLHIQRNVQKL*
*KDTVKKLGESGEIKAIGELDLLFMSLRNACI*;
and (ix) MAMAEVQLLESGGGLVQPGGSLRLSCAASGFTFSSYAMSWVRQAPGKGLEWVSSITA [SEQ ID NO: 163]
EGTHTWYADSVKGRFTISRDNSKNTLYLQMNSLRAEDTAVYYCAKTSYRFDYWGQGTLVTVSSGG
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHHG
AAEQKLISEEDLN*APISSHCRLDKSNFQQPYITNRTFMLAKEASLADNNTDVRLIGEKLFHGVSMSER*
*CYLMKQVLNFTLEEVLFPQSDRFQPYMQEWPFLARLSNRLSTCHIEGDDLHIQRNVQKLKDTVKKL*
*GESGEIKAIGELDLLFMSLRNACI*,
wherein:

AMAEVQLLESGGGLVQPGGSLRLSCAASGFTFSSYAMSWVRQAPGKGLEWVSSITAEGTH [SEQ ID NO: 57]
TWYADSVKGRFTISRDNSKNTLYLQMNSLRAEDTAVYYCAKTSYRFDYWGQGTLVTVSSGGGGSG
GGGSGGGGSTDIQMTQSPSSLSASVGDRVTITCRASQSISSYLNWYQQKPGKAPKLLIYKASRLQS
GVPSRFSGSGSGTDFTLTISSLQPEDFATYYCQQKWDPPRTFGQGTKVEIKRAAAHHHHHHGAAEQ
KLISEEDLN = β-cell specific scFv;

Underlined Text is Flexible Linker;
Text in italics is IL-22 mature polypeptide;
M is an artificial methionine for recombinant expression;
and
n=1 or more, suitably 1, 2, 3, 4, 5, 6, 7, 8, 9 or 10, or (x) M*APISSHCRLDKSNFQQPYITNRTFMLAKEASLADNNTDVRLIGEKLFHGVSMSERCYL* [SEQ ID NO: 164]
*MKQVLNFTLEEVLFPQSDRFQPYMQEVVPFLARLSNRLSTCHIEGDDLHIQRNVQKLKDTVKKLGES*
*GEIKAIGELDLLFMSLRNACI*[GGGGSGGGGSGGGGSGGGGS]<sub>n</sub>AMAEVQLLESGGGLVQPGGSLR
LSCAASGFTFSSYAMSWVRQAPGKGLEWVSSITAEGTHTWYADSVKGRFTISRDNSKNTLYLQMN
SLRAEDTAVYYCAKTSYRFDYWGQGTLVTVSSGGGGSGGGGSGGGGSTDIQMTQSPSSLSASVG
DRVTITCRASQSISSYLNWYQQKPGKAPKLLIYKASRLQSGVPSRFSGSGSGTDFTLTISSLQPEDFA
TYYCQQKWDPPRTFGQGTKVEIKRAAAHHHHHHGAAEQKLISEEDLN;

(xi) M*APISSHCRLDKSNFQQPYITNRTFMLAKEASLADNNTDVRLIGEKLFHGVSMSERCYL* [SEQ ID NO: 165]
*MKQVLNFTLEEVLFPQSDRFQPYMQEWPFLARLSNRLSTCHIEGDDLHIQRNVQKLKDTVKKLGES*
*GEIKAIGELDLLFMSLRNACI*[GGGSGGGS]<sub>n</sub>AMAEVQLLESGGGLVQPGGSLRLSCAASGFTFSSYA
MSWVRQAPGKGLEWVSSITAEGTHTWYADSVKGRFTISRDNSKNTLYLQMNSLRAEDTAVYYCAK
TSYRFDYWGQGTLVTVSSGGGGSGGGGSGGGGSTDIQMTQSPSSLSASVGDRVTITCRASQSISS
YLNWYQQKPGKAPKLLIYKASRLQSGVPSRFSGSGSGTDFTLTISSLQPEDFATYYCQQKWDPPRTF
GQGTKVEIKRAAAHHHHHHGAAEQKLISEEDLN;

[SEQ ID NO: 166]
(xii) MAPISSHCRLDKSNFQQPYITNRTFMLAKEASLADNNTDVRLIGEKLFHGVSMSERCY
LMKQVLNFTLEEVLFPQSDRFQPYMQEWPFLARLSNRLSTCHIEGDDLHIQRNVQKLKDTVKKLGE
SGEIKAIGELDLLFMSLRNACI[GGGG]<sub>n</sub>AMAEVQLLESGGGLVQPGGSLRLSCAASGFTFSSYAMS
WVRQAPGKGLEWVSSITAEGTHTWYADSVKGRFTISRDNSKNTLYLQMNSLRAEDTAVYYCAKTSY
RFDYWGQGTLVTVSSGGGGSGGGGSGGGGSTDIQMTQSPSSLSASVGDRVTITCRASQSISSYLN
WYQQKPGKAPKLLIYKASRLQSGVPSRFSGSGSGTDFTLTISSLQPEDFATYYCQQKWDPPRTFGQ
GTKVEIKRAAAHHHHHHGAAEQKLISEEDLN;

[SEQ ID NO: 167]
(xiii) MAPISSHCRLDKSNFQQPYITNRTFMLAKEASLADNNTDVRLIGEKLFHGVSMSERCY
LMKQVLNFTLEEVLFPQSDRFQPYMQEWPFLARLSNRLSTCHIEGDDLHIQRNVQKLKDTVKKLGE
SGEIKAIGELDLLFMSLRNACI[GGGGG]<sub>n</sub>AMAEVQLLESGGGLVQPGGSLRLSCAASGFTFSSYAMS
WVRQAPGKGLEWVSSITAEGTHTWYADSVKGRFTISRDNSKNTLYLQMNSLRAEDTAVYYCAKTSY
RFDYWGQGTLVTVSSGGGGSGGGGSGGGGSTDIQMTQSPSSLSASVGDRVTITCRASQSISSYLN
WYQQKPGKAPKLLIYKASRLQSGVPSRFSGSGSGTDFTLTISSLQPEDFATYYCQQKWDPPRTFGQ
GTKVEIKRAAAHHHHHHGAAEQKLISEEDLN;

[SEQ ID NO: 168]
(xiv) MAPISSHCRLDKSNFQQPYITNRTFMLAKEASLADNNTDVRLIGEKLFHGVSMSERCY
LMKQVLNFTLEEVLFPQSDRFQPYMQEWPFLARLSNRLSTCHIEGDDLHIQRNVQKLKDTVKKLGE
SGEIKAIGELDLLFMSLRNACI[GGGKGGGG]<sub>n</sub>AMAEVQLLESGGGLVQPGGSLRLSCAASGFTFSSY
AMSWVRQAPGKGLEWVSSITAEGTHTWYADSVKGRFTISRDNSKNTLYLQMNSLRAEDTAVYYCA
KTSYRFDYWGQGTLVTVSSGGGGSGGGGSGGGGSTDIQMTQSPSSLSASVGDRVTITCRASQSIS
SYLNWYQQKPGKAPKLLIYKASRLQSGVPSRFSGSGSGTDFTLTISSLQPEDFATYYCQQKWDPPRT
FGQGTKVEIKRAAAHHHHHHGAAEQKLISEEDLN;

[SEQ ID NO: 169]
(xv) MAPISSHCRLDKSNFQQPYITNRTFMLAKEASLADNNTDVRLIGEKLFHGVSMSERCY
LMKQVLNFTLEEVLFPQSDRFQPYMQEWPFLARLSNRLSTCHIEGDDLHIQRNVQKLKDTVKKLGE
SGEIKAIGELDLLFMSLRNACI[GGGNGSGG]<sub>n</sub>AMAEVQLLESGGGLVQPGGSLRLSCAASGFTFSSY
AMSWVRQAPGKGLEWVSSITAEGTHTWYADSVKGRFTISRDNSKNTLYLQMNSLRAEDTAVYYCA
KTSYRFDYWGQGTLVTVSSGGGGSGGGGSGGGGSTDIQMTQSPSSLSASVGDRVTITCRASQSIS
SYLNWYQQKPGKAPKLLIYKASRLQSGVPSRFSGSGSGTDFTLTISSLQPEDFATYYCQQKWDPPRT
FGQGTKVEIKRAAAHHHHHHGAAEQKLISEEDLN;

[SEQ ID NO: 170]
(xvii) MAPISSHCRLDKSNFQQPYITNRTFMLAKEASLADNNTDVRLIGEKLFHGVSMSERC
YLMKQVLNFTLEEVLFPQSDRFQPYMQEVVPFLARLSNRLSTCHIEGDDLHIQRNVQKLKDTVKKLGE
SGEIKAIGELDLLFMSLRNACI[GGGCGGGG]<sub>n</sub>AMAEVQLLESGGGLVQPGGSLRLSCAASGFTFSSY
AMSWVRQAPGKGLEWVSSITAEGTHTWYADSVKGRFTISRDNSKNTLYLQMNSLRAEDTAVYYCA
KTSYRFDYWGQGTLVTVSSGGGGSGGGGSGGGGSTDIQMTQSPSSLSASVGDRVTITCRASQSIS
SYLNWYQQKPGKAPKLLIYKASRLQSGVPSRFSGSGSGTDFTLTISSLQPEDFATYYCQQKWDPPRT
FGQGTKVEIKRAAAHHHHHHGAAEQKLISEEDLN;

[SEQ ID NO: 171]
(xviii) MAPISSHCRLDKSNFQQPYITNRTFMLAKEASLADNNTDVRLIGEKLFHGVSMSERC
YLMKQVLNFTLEEVLFPQSDRFQPYMQEVVPFLARLSNRLSTCHIEGDDLHIQRNVQKLKDTVKKLGE -continued

*SGEIKAIGELDLLFMSLRNACI*[GPNGG]*ₙ*AMAEVQLLESGGGLVQPGGSLRLSCAASGFTFSSYAMS

WVRQAPGKGLEWVSSITAEGTHTWYADSVKGRFTISRDNSKNTLYLQMNSLRAEDTAVYYCAKTSY

RFDYWGQGTLVTVSSGGGGSGGGGSGGGGSTDIQMTQSPSSLSASVGDRVTITCRASQSISSYLN

WYQQKPGKAPKLLIYKASRLQSGVPSRFSGSGSGTDFTLTISSLQPEDFATYYCQQKWDPPRTFGQ

GTKVEIKRAAAHHHHHHGAAEQKLISEEDLN;
and

[SEQ ID NO: 172]
(xix) M*APISSHCRLDKSNFQQPYITNRTFMLAKEASLADNNTDVRLIGEKLFHGVSMSERCY*

*LMKQVLNFTLEEVLFPQSDRFQPYMQEWPFLARLSNRLSTCHIEGDDLHIQRNVQKLKDTVKKLGE*

*SGEIKAIGELDLLFMSLRNACI*QIAMAEVQLLESGGGLVQPGGSLRLSCAASGFTFSSYAMSWVRQA

PGKGLEWVSSITAEGTHTWYADSVKGRFTISRDNSKNTLYLQMNSLRAEDTAVYYCAKTSYRFDYW

GQGTLVTVSSGGGGSGGGGSGGGGSTDIQMTQSPSSLSASVGDRVTITCRASQSISSYLNWYQQ

KPGKAPKLLIYKASRLQSGVPSRFSGSGSGTDFTLTISSLQPEDFATYYCQQKWDPPRTFGQGTKVEI

KRAAAHHHHHHGAAEQKLISEEDLN,
wherein:

[SEQ ID NO: 57]
AMAEVQLLESGGGLVQPGGSLRLSCAASGFTFSSYAMSWVRQAPGKGLEWVSSITAEGTH

TWYADSVKGRFTISRDNSKNTLYLQMNSLRAEDTAVYYCAKTSYRFDYWGQGTLVTVSSGGGGSG

GGGSGGGGSTDIQMTQSPSSLSASVGDRVTITCRASQSISSYLNWYQQKPGKAPKLLIYKASRLQS

GVPSRFSGSGSGTDFTLTISSLQPEDFATYYCQQKWDPPRTFGQGTKVEIKRAAAHHHHHHGAAEQ

KLISEEDLN = β-cell specific scFv,

Underlined Text is Flexible Linker;
Text in italics is IL-22 mature polypeptide;
M is an artificial methionine for recombinant expression;
and
n=1 or more, suitably 1, 2, 3, 4, 5, 6, 7, 8, 9 or 10;
In other embodiments, the chimeric constructs comprise alternative β=cell specific scFv substituted for the scFv defined above, illustrative examples of which include:

[SEQ ID NO: 58]
AMAEVQLLESGGGLVQPGGSLRLSCAASGFTFSSYAMSWVRQAPGKGLEWVSRIKIFGSKT

KFADSVKGRFTISRDNSKNTLYLQMNSLRAEDTAVYYCAKHSTHFDYWGQGTLVTVSSGGGGSGG

GGSGGGGSTDIQMTQSPSSLSASVGDRVTITCRASQSISSYLNWYQQKPGKAPKLLIYRASSLQSG

VPSRFSGSGSGTDFTLTISSLQPEDFATYYCQQLQSTPRTFGQGTKVEIKRAAAHHHHHHGAAEQKL

ISEEDLN;

[SEQ ID NO: 59]
AMAEVQLLESGGGLVQPGGSLRLSCAASGFTFSSYAMSWVRQAPGKGLEWVSSIHPKGYP

TRYADSVKGRFTISRDNSKNTLYLQMNSLRAEDTAVYYCAKSTTPFDYWGQGTLVTVSSGGGGSGG

GGSGGGGSTDIQMTQSPSSLSASVGDRVTITCRASQSISSYLNWYQQKPGKAPKLLIYAASSLQSG

VPSRFSGSGSGTDFTLTISSLQPEDFATYYCQQMGRDPRTFGQGTKVEIKRAAAHHHHHHGAAEQK

LISEEDLN;

[SEQ ID NO: 60]
AMAEVQLLESGGGLVQPGGSLRLSCAASGFTFSSYAMSWVRQAPGKGLEWVSRIQFFGSH

TYFADSVKGRFTISRDNSKNTLYLQMNSLRAEDTAVYYCAKHSTHFDYWGQGTLVTVSSGGGGSG

```
GGGSGGGGSTDIMTQSPSSLSASVGDRVTITCRASQSISSYLNWYQQKPGKAPKLLIYRASILQSGV

PSRFSGSGSGTDFTLTISSLQPEDFATYYCQQNRRIPRTFGQGTKVEIKRAAAHHHHHHGAAEQKLI

SEEDLN;
and
                                                            [SEQ ID NO: 61]
AMAEVQLLESGGGLVQPGGSLRLSCAASGFTFSSYAMSWVRQAPGKGLEWVSSISSTGDS

TSYADSVKGRFTISRDNSKNTLYLQMNSLRAEDTAVYYCAKAADSFDYWGQGTLVTVSSGGGGSG

GGGSGGGGSTDIQMTQSPSSLSASVGDRVTITCRASQSISSYLNWYQQKPGKAPKLLIYGASSLQS

GVPSRFSGSGSGTDFTLTISSLQPEDFATYYCQQTNGAPTTFGQGTKVEIKRAAAHHHHHHGAAEQ

KLISEEDLN.
```

In other embodiments, the OER stress inhibitor is an IL-22 polypeptide and the targeting agent is a proteinaceous SUR1 agonist such as α-endosulfine. Illustrative constructs of this type include:

```
                                                            [SEQ ID NO: 173]
(1) MSQKQEEENPAEETGEEKQDTQEKEGILPERAEEAKLKAKYPSLGQKPGGSDFLMKRL

QKGQKYFDSGDYNMAKAKMKNKQLPSAGPDKNLVTGDHIPTPQDLPQRKSSLVTSKLAGGQV[GG

GGSGGGGSGGGGSGGGGS]ₙAPISSHCRLDKSNFQQPYITNRTFMLAKEASLADNNTDVRLIGEKL

FHGVSMSERCYLMKQVLNFTLEEVLFPQSDRFQPYMQEWPFLARLSNRLSTCHIEGDDLHIQRNVQ

KLKDTVKKLGESGEIKAIGELDLLFMSLRNACIX;

[SEQ ID NO: 174]
(2) MSQKQEEENPAEETGEEKQDTQEKEGILPERAEEAKLKAKYPSLGQKPGGSDFLMKRL

QKGQKYFDSGDYNMAKAKMKNKQLPSAGPDKNLVTGDHIPTPQDLPQRKSSLVTSKLAGGQV[GG

GSGGGS]ₙAPISSHCRLDKSNFQQPYITNRTFMLAKEASLADNNTDVRLIGEKLFHGVSMSERCYLM

KQVLNFTLEEVLFPQSDRFQPYMQEWPFLARLSNRLSTCHIEGDDLHIQRNVQKLKDTVKKLGESG

EIKAIGELDLLFMSLRNACIX;

[SEQ ID NO: 175]
(3) MSQKQEEENPAEETGEEKQDTQEKEGILPERAEEAKLKAKYPSLGQKPGGSDFLMKRL

QKGQKYFDSGDYNMAKAKMKNKQLPSAGPDKNLVTGDHIPTPQDLPQRKSSLVTSKLAGGQV[GG

GG]ₙAPISSHCRLDKSNFQQPYITNRTFMLAKEASLADNNTDVRLIGEKLFHGVSMSERCYLMKQVLN

FTLEEVLFPQSDRFQPYMQEVVPFLARLSNRLSTCHIEGDDLHIQRNVQKLKDTVKKLGESGEIKAIG

ELDLLFMSLRNACIX;

[SEQ ID NO: 176]
(4) MSQKQEEENPAEETGEEKQDTQEKEGILPERAEEAKLKAKYPSLGQKPGGSDFLMKRL

QKGQKYFDSGDYNMAKAKMKNKQLPSAGPDKNLVTGDHIPTPQDLPQRKSSLVTSKLAGGQV[GG

GGG]ₙAPISSHCRLDKSNFQQPYITNRTFMLAKEASLADNNTDVRLIGEKLFHGVSMSERCYLMKQVL

NFTLEEVLFPQSDRFQPYMQEWPFLARLSNRLSTCHIEGDDLHIQRNVQKLKDTVKKLGESGEIKAI

GELDLLFMSLRNACIX;

[SEQ ID NO: 177]
(5) MSQKQEEENPAEETGEEKQDTQEKEGILPERAEEAKLKAKYPSLGQKPGGSDFLMKRL

QKGQKYFDSGDYNMAKAKMKNKQLPSAGPDKNLVTGDHIPTPQDLPQRKSSLVTSKLAGGQV[GG

GKGGGG]ₙAPISSHCRLDKSNFQQPYITNRTFMLAKEASLADNNTDVRLIGEKLFHGVSMSERCYLM

KQVLNFTLEEVLFPQSDRFQPYMQEWPFLARLSNRLSTCHIEGDDLHIQRNVQKLKDTVKKLGESG

EIKAIGELDLLFMSLRNACIX;
```

-continued (6) MSQKQEEENPAEETGEEKQDTQEKEGILPERAEEAKLKAKYPSLGQKPGGSDFLMKRL [SEQ ID NO: 178]
QKGQKYFDSGDYNMAKAKMKNKQLPSAGPDKNLVTGDHIPTPQDLPQRKSSLVTSKLAGGQV[GG
GNGSGG]<sub>n</sub>*APISSHCRLDKSNFQQPYITNRTFMLAKEASLADNNTDVRLIGEKLFHGVSMSERCYLM
KQVLNFTLEEVLFPQSDRFQPYMQEVVPFLARLSNRLSTCHIEGDDLHIQRNVQKLKDTVKKLGESG
EIKAIGELDLLFMSLRNACI*X;

(7) MSQKQEEENPAEETGEEKQDTQEKEGILPERAEEAKLKAKYPSLGQKPGGSDFLMKRL [SEQ ID NO: 179]
QKGQKYFDSGDYNMAKAKMKNKQLPSAGPDKNLVTGDHIPTPQDLPQRKSSLVTSKLAGGQV[GG
GCGGGG]<sub>n</sub>*APISSHCRLDKSNFQQPYITNRTFMLAKEASLADNNTDVRLIGEKLFHGVSMSERCYLM
KQVLNFTLEEVLFPQSDRFQPYMQEWPFLARLSNRLSTCHIEGDDLHIQRNVQKLKDTVKKLGESG
EIKAIGELDLLFMSLRNACI*X;

(8) MSQKQEEENPAEETGEEKQDTQEKEGILPERAEEAKLKAKYPSLGQKPGGSDFLMKRL [SEQ ID NO: 180]
QKGQKYFDSGDYNMAKAKMKNKQLPSAGPDKNLVTGDHIPTPQDLPQRKSSLVTSKLAGGQV[GP
NGG]<sub>n</sub>*APISSHCRLDKSNFQQPYITNRTFMLAKEASLADNNTDVRLIGEKLFHGVSMSERCYLMKQVL
NFTLEEVLFPQSDRFQPYMQEWPFLARLSNRLSTCHIEGDDLHIQRNVQKLKDTVKKLGESGEIKAI
GELDLLFMSLRNACI*X;
and (9) MSQKQEEENPAEETGEEKQDTQEKEGILPERAEEAKLKAKYPSLGQKPGGSDFLMKRL [SEQ ID NO: 181]
QKGQKYFDSGDYNMAKAKMKNKQLPSAGPDKNLVTGDHIPTPQDLPQRKSSLVTSKLAGGQV*APIS
SHCRLDKSNFQQPYITNRTFMLAKEASLADNNTDVRLIGEKLFHGVSMSERCYLMKQVLNFTLEEVLF
PQSDRFQPYMQEVVPFLARLSNRLSTCHIEGDDLHIQRNVQKLKDTVKKLGESGEIKAIGELDLLFMS
LRNACI*X,
wherein:

MSQKQEEENPAEETGEEKQDTQEKEGILPERAEEAKLKAKYPSLGQKPGGSDFLMKRLQKG [SEQ ID NO: 46]
QKYFDSGDYNMAKAKMKNKQLPSAGPDKNLVTGDHIPTPQDLPQRKSSLVTSKLAGGQV =
α-endosulfine;

Underlined Text is Flexible Linker;
Text in italics is IL-22 mature polypeptide;
n=1 or more, suitably 1, 2, 3, 4, 5, 6, 7, 8, 9 or 10; and
X is an optional tag (e.g., FLAGS, His6) for purification,
or

(10) MXH*APISSHCRLDKSNFQQPYITNRTFMLAKEASLADNNTDVRLIGEKLFHGVSMSER* [SEQ ID NO: 182]
*CYLMKQVLNFTLEEVLFPQSDRFQPYMQEWPFLARLSNRLSTCHIEGDDLHIQRNVQKLKDTVKKL
GESGEIKAIGELDLLFMSLRNACI*[GGGGSGGGGSGGGGSGGGG]<sub>n</sub>SQKQEEENPAEETGEEKQDT
QEKEGILPERAEEAKLKAKYPSLGQKPGGSDFLMKRLQKGQKYFDSGDYNMAKAKMKNKQLPSAGP
DKNLVTGDHIPTPQDLPQRKSSLVTSKLAGGQV;

(11) MX*APISSHCRLDKSNFQQPYITNRTFMLAKEASLADNNTDVRLIGEKLFHGVSMSERC* [SEQ ID NO: 183]
*YLMKQVLNFTLEEVLFPQSDRFQPYMQEVVPFLARLSNRLSTCHIEGDDLHIQRNVQKLKDTVKKLGE*

-continued

SGEIKAIGELDLLFMSLRNACI[GGGSGGGS]<sub>n</sub>SQKQEEENPAEETGEEKQDTQEKEGILPERAEEAK
LKAKYPSLGQKPGGSDFLMKRLQKGQKYFDSGDYNMAKAKMKNKQLPSAGPDKNLVTGDHIPTPQ
DLPQRKSSLVTSKLAGGQV;

[SEQ ID NO: 184]
(12) MXAPISSHCRLDKSNFQQPYITNRTFMLAKEASLADNNTDVRLIGEKLFHGVSMSERC
YLMKQVLNFTLEEVLFPQSDRFQPYMQEVVPFLARLSNRLSTCHIEGDDLHIQRNVQKLKDTVKKLGE
SGEIKAIGELDLLFMSLRNACI[GGGG]<sub>n</sub>SQKQEEENPAEETGEEKQDTQEKEGILPERAEEAKLKAKY
PSLGQKPGGSDFLMKRLQKGQKYFDSGDYNMAKAKMKNKQLPSAGPDKNLVTGDHIPTPQDLPQR
KSSLVTSKLAGGQV;

[SEQ ID NO: 185]
(13) MXAPISSHCRLDKSNFQQPYITNRTFMLAKEASLADNNTDVRLIGEKLFHGVSMSERC
YLMKQVLNFTLEEVLFPQSDRFQPYMQEVVPFLARLSNRLSTCHIEGDDLHIQRNVQKLKDTVKKLGE
SGEIKAIGELDLLFMSLRNACI[GGGGG]<sub>n</sub>SQKQEEENPAEETGEEKQDTQEKEGILPERAEEAKLKAK
YPSLGQKPGGSDFLMKRLQKGQKYFDSGDYNMAKAKMKNKQLPSAGPDKNLVTGDHIPTPQDLPQ
RKSSLVTSKLAGGQV;

[SEQ ID NO: 186]
(14) MXAPISSHCRLDKSNFQQPYITNRTFMLAKEASLADNNTDVRLIGEKLFHGVSMSERC
YLMKQVLNFTLEEVLFPQSDRFQPYMQEVVPFLARLSNRLSTCHIEGDDLHIQRNVQKLKDTVKKLGE
SGEIKAIGELDLLFMSLRNACI[GGGKGGGG]<sub>n</sub>SQKQEEENPAEETGEEKQDTQEKEGILPERAEEAK
LKAKYPSLGQKPGGSDFLMKRLQKGQKYFDSGDYNMAKAKMKNKQLPSAGPDKNLVTGDHIPTPQ
DLPQRKSSLVTSKLAGGQV;

[SEQ ID NO: 187]
(15) MXAPISSHCRLDKSNFQQPYITNRTFMLAKEASLADNNTDVRLIGEKLFHGVSMSERC
YLMKQVLNFTLEEVLFPQSDRFQPYMQEVVPFLARLSNRLSTCHIEGDDLHIQRNVQKLKDTVKKLGE
SGEIKAIGELDLLFMSLRNACI[GGGNGSGG]<sub>n</sub>SQKQEEENPAEETGEEKQDTQEKEGILPERAEEAK
LKAKYPSLGQKPGGSDFLMKRLQKGQKYFDSGDYNMAKAKMKNKQLPSAGPDKNLVTGDHIPTPQ
DLPQRKSSLVTSKLAGGQV;

[SEQ ID NO: 188]
(16) MXAPISSHCRLDKSNFQQPYITNRTFMLAKEASLADNNTDVRLIGEKLFHGVSMSERC
YLMKQVLNFTLEEVLFPQSDRFQPYMQEVVPFLARLSNRLSTCHIEGDDLHIQRNVQKLKDTVKKLGE
SGEIKAIGELDLLFMSLRNACI[GGGCGGGG]<sub>n</sub>SQKQEEENPAEETGEEKQDTQEKEGILPERAEEAK
LKAKYPSLGQKPGGSDFLMKRLQKGQKYFDSGDYNMAKAKMKNKQLPSAGPDKNLVTGDHIPTPQ
DLPQRKSSLVTSKLAGGQV;

[SEQ ID NO: 189]
(17) MXAPISSHCRLDKSNFQQPYITNRTFMLAKEASLADNNTDVRLIGEKLFHGVSMSERC
YLMKQVLNFTLEEVLFPQSDRFQPYMQEVVPFLARLSNRLSTCHIEGDDLHIQRNVQKLKDTVKKLGE
SGEIKAIGELDLLFMSLRNACI[GPNGG]<sub>n</sub>SQKQEEENPAEETGEEKQDTQEKEGILPERAEEAKLKAK
YPSLGQKPGGSDFLMKRLQKGQKYFDSGDYNMAKAKMKNKQLPSAGPDKNLVTGDHIPTPQDLPQ
RKSSLVTSKLAGGQV;
and

[SEQ ID NO: 190]
(18) MXAPISSHCRLDKSNFQQPYITNRTFMLAKEASLADNNTDVRLIGEKLFHGVSMSERC
YLMKQVLNFTLEEVLFPQSDRFQPYMQEVVPFLARLSNRLSTCHIEGDDLHIQRNVQKLKDTVKKLGE

-continued

*SGEIKAIGELDLLFMSLRNACIS*QKQEEENPAEETGEEKQDTQEKEGILPERAEEAKLKAKYPSLGQK

PGGSDFLMKRLQKGQKYFDSGDYNMAKAKMKNKQLPSAGPDKNLVTGDHIPTPQDLPQRKSSLVT

SKLAGGQV,
wherein:

[SEQ ID NO: 191]

SQKQEEENPAEETGEEKQDTQEKEGILPERAEEAKLKAKYPSLGQKPGGSDFLMKRLQKGQ

KYFDSGDYNMAKAKMKNKQLPSAGPDKNLVTGDHIPTPQDLPQRKSSLVTSKLAGGQV =

α-endosulfine without initial methionine;

Underlined Text is Flexible Linker;
Text in italics is IL-22 mature polypeptide;
M is an artificial methionine for recombinant expression;
n=1 or more, suitably 1, 2, 3, 4, 5, 6, 7, 8, 9 or 10; and
X is an optional tag (e.g., FLAGS, His6) for purification.

In other embodiments, the OER stress inhibitor is part of a soluble receptor that binds to IL-24 and the targeting agent is an antigen-binding molecule that is immuno-interactive with a β-cell surface binding protein as taught for example in WO 2010/096930. Non-limiting examples of constructs of this type include:

[SEQ ID NO: 212]

(A) MX*VPCVSGGLPKPANITFLSINMKNVLQWTPPEGLQGVKVTYTVQYFIYGQKKWLNKS*

*ECRNINRTYCDLSAETSDYEHQYYAKVKAIWGTKCSKWAESGRFYPFLETQIGPPEVALTTDEKSISV*

*VLTAPEKWKRNPEDLPVSMQQIYSNLKYNVSVLNTKSNRTWSQCVTNHTLVLTWLEPNTLYCVHVE*

*SFVPGPPRRAQPSEKQCARTLKDQSSEASTKGPSVFPLAPSSKSTSGGTAALGCLVKDYFPEPVTVS*

*WNSGALTSGVHTFPAVLQSSGLYSLSSVVTVPSSSLGTQTYICNVNHKPSNTKVDKKVEPKSCDKT*

*HTCPPCPAPELLGGPSVFLFPPKPKDTLMISRTPEVTCVVVDVSHEDPEVKFNWYVDGVEVHNAKTKP*

*REEQYNSTYRWSVLTVLHQDWLNGKEYKCKVSNKALPAPIEKTISKAKGQPREPQVYTLPPSRDELT*

*KNQVSLTCLVKGFYPSDIAVEWESNGQPENNYKTTPPVLDSDGSFFLYSKLTVDKSRWQQGNVFSC*

*SVMHEALHNHYTQKSLSLSPGK*[GGGGSGGGGSGGGGSGGGGS]<sub>n</sub>*AMAEVQLLESGGGLVQPGG*

*SLRLSCAASGFTFSSYAMSWVRQAPGKGLEWVSSITAEGTHTWYADSVKGRFTISRDNSKNTLYLQ*

*MNSLRAEDTAVYYCAKTSYRFDYWGQGTLVTVSSGGGGSGGGGSGGGGSTDIQMTQSPSSLSAS*

*VGDRVTITCRASQSISSYLNWYQQKPGKAPKLLIYKASRLQSGVPSRFSGSGSGTDFTLTISSLQPED*

*FATYYCQQKWDPPRTFGQGTKVEIKR*AAAHHHHHHGAAEQKLISEEDLN;

[SEQ ID NO: 213]

(B) MX*VPCVSGGLPKPANITFLSINMKNVLQWTPPEGLQGVKVTYTVQYFIYGQKKWLNKS*

*ECRNINRTYCDLSAETSDYEHQYYAKVKAIWGTKCSKWAESGRFYPFLETQIGPPEVALTTDEKSISV*

*VLTAPEKWKRNPEDLPVSMQQIYSNLKYNVSVLNTKSNRTWSQCVTNHTLVLTWLEPNTLYCVHVE*

*SFVPGPPRRAQPSEKQCARTLKDQSSEASTKGPSVFPLAPSSKSTSGGTAALGCLVKDYFPEPVTVS*

*WNSGALTSGVHTFPAVLQSSGLYSLSSVVTVPSSSLGTQTYICNVNHKPSNTKVDKKVEPKSCDKT*

*HTCPPCPAPELLGGPSVFLFPPKPKDTLMISRTPEVTCVVVDVSHEDPEVKFNWYVDGVEVHNAKTKP*

*REEQYNSTYRWSVLTVLHQDWLNGKEYKCKVSNKALPAPIEKTISKAKGQPREPQVYTLPPSRDELT*

*KNQVSLTCLVKGFYPSDIAVEWESNGQPENNYKTTPPVLDSDGSFFLYSKLTVDKSRWQQGNVFSC*

*SVMHEALHNHYTQKSLSLSPGK*[GGGSGGGS]<sub>n</sub>*AMAEVQLLESGGGLVQPGGSLRLSCAASGFTFS*

*SYAMSWVRQAPGKGLEWVSSITAEGTHTWYADSVKGRFTISRDNSKNTLYLQMNSLRAEDTAVYY*

*CAKTSYRFDYWGQGTLVTVSSGGGGSGGGGSGGGGSTDIQMTQSPSSLSASVGDRVTITCRASQ*

*SISSYLNWYQQKPGKAPKLLIYKASRLQSGVPSRFSGSGSGTDFTLTISSLQPEDFATYYCQQKWDP*

*PRTFGQGTKVEIKR*AAAHHHHHHGAAEQKLISEEDLN;

-continued

[SEQ ID NO: 214]
(C) MXVPCVSGGLPKPANITFLSINMKNVLQWTPPEGLQGVKVTYTVQYFIYGQKKWLNKS
ECRNINRTYCDLSAETSDYEHQYYAKVKAIWGTKCSKWAESGRFYPFLETQIGPPEVALTTDEKSISV
VLTAPEKWKRNPEDLPVSMQQIYSNLKYNVSVLNTKSNRTWSQCVTNHTLVLTWLEPNTLYCVHVE
SFVPGPPRRAQPSEKQCARTLKDQSSEASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKT
HTCPPCPAPELLGGPSVFLFPPKPKDTLMISRTPEVTCVVVDVSHEDPEVKFNWYVDGVEVHNAKTKP
REEQYNSTYRWSVLTVLHQDWLNGKEYKCKVSNKALPAPIEKTISKAKGQPREPQVYTLPPSRDELT
KNQVSLTCLVKGFYPSDIAVEWESNGQPENNYKTTPPVLDSDGSFFLYSKLTVDKSRWQQGNVFSC
SVMHEALHNHYTQKSLSLSPGK[GGGG]ₙAMAEVQLLESGGGLVQPGGSLRLSCAASGFTFSSYAM
SWVRQAPGKGLEWVSSITAEGTHTWYADSVKGRFTISRDNSKNTLYLQMNSLRAEDTAVYYCAKTS
YRFDYWGQGTLVTVSSGGGGSGGGGSGGGGSTDIQMTQSPSSLSASVGDRVTITCRASQSISSYL
NWYQQKPGKAPKLLIYKASRLQSGVPSRFSGSGSGTDFTLTISSLQPEDFATYYCQQKWDPPRTFG
QGTKVEIKRAAAHHHHHHGAAEQKLISEEDLN;

[SEQ ID NO: 215]
(D) MXVPCVSGGLPKPANITFLSINMKNVLQWTPPEGLQGVKVTYTVQYFIYGQKKWLNKS
ECRNINRTYCDLSAETSDYEHQYYAKVKAIWGTKCSKWAESGRFYPFLETQIGPPEVALTTDEKSISV
VLTAPEKWKRNPEDLPVSMQQIYSNLKYNVSVLNTKSNRTWSQCVTNHTLVLTWLEPNTLYCVHVE
SFVPGPPRRAQPSEKQCARTLKDQSSEASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKT
HTCPPCPAPELLGGPSVFLFPPKPKDTLMISRTPEVTCVVVDVSHEDPEVKFNWYVDGVEVHNAKTKP
REEQYNSTYRWSVLTVLHQDWLNGKEYKCKVSNKALPAPIEKTISKAKGQPREPQVYTLPPSRDELT
KNQVSLTCLVKGFYPSDIAVEWESNGQPENNYKTTPPVLDSDGSFFLYSKLTVDKSRWQQGNVFSC
SVMHEALHNHYTQKSLSLSPGK[GGGGG]ₙAMAEVQLLESGGGLVQPGGSLRLSCAASGFTFSSYA
MSWVRQAPGKGLEWVSSITAEGTHTWYADSVKGRFTISRDNSKNTLYLQMNSLRAEDTAVYYCAK
TSYRFDYWGQGTLVTVSSGGGGSGGGGSGGGGSTDIQMTQSPSSLSASVGDRVTITCRASQSISS
YLNWYQQKPGKAPKLLIYKASRLQSGVPSRFSGSGSGTDFTLTISSLQPEDFATYYCQQKWDPPRTF
GQGTKVEIKRAAAHHHHHHGAAEQKLISEEDLN;

[SEQ ID NO: 216]
(E) MXVPCVSGGLPKPANITFLSINMKNVLQWTPPEGLQGVKVTYTVQYFIYGQKKWLNKS
ECRNINRTYCDLSAETSDYEHQYYAKVKAIWGTKCSKWAESGRFYPFLETQIGPPEVALTTDEKSISV
VLTAPEKWKRNPEDLPVSMQQIYSNLKYNVSVLNTKSNRTWSQCVTNHTLVLTWLEPNTLYCVHVE
SFVPGPPRRAQPSEKQCARTLKDQSSEASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKT
HTCPPCPAPELLGGPSVFLFPPKPKDTLMISRTPEVTCVVVDVSHEDPEVKFNWYVDGVEVHNAKTKP
REEQYNSTYRWSVLTVLHQDWLNGKEYKCKVSNKALPAPIEKTISKAKGQPREPQVYTLPPSRDELT
KNQVSLTCLVKGFYPSDIAVEWESNGQPENNYKTTPPVLDSDGSFFLYSKLTVDKSRWQQGNVFSC
SVMHEALHNHYTQKSLSLSPGK[GGGKGGGG]ₙAMAEVQLLESGGGLVQPGGSLRLSCAASGFTFS
SYAMSWVRQAPGKGLEWVSSITAEGTHTWYADSVKGRFTISRDNSKNTLYLQMNSLRAEDTAVYY
CAKTSYRFDYWGQGTLVTVSSGGGGSGGGGSGGGGSTDIQMTQSPSSLSASVGDRVTITCRASQ
SISSYLNWYQQKPGKAPKLLIYKASRLQSGVPSRFSGSGSGTDFTLTISSLQPEDFATYYCQQKWDP
PRTFGQGTKVEIKRAAAHHHHHHGAAEQKLISEEDLN;

-continued

[SEQ ID NO: 217]
(F) MXVPCVSGGLPKPANITFLSINMKNVLQWTPPEGLQGVKVTYTVQYFIYGQKKWLNKS
ECRNINRTYCDLSAETSDYEHQYYAKVKAIWGTKCSKWAESGRFYPFLETQIGPPEVALTTDEKSISV
VLTAPEKWKRNPEDLPVSMQQIYSNLKYNVSVLNTKSNRTWSQCVTNHTLVLTWLEPNTLYCVHVE
SFVPGPPRRAQPSEKQCARTLKDQSSEASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKT
HTCPPCPAPELLGGPSVFLFPPKPKDTLMISRTPEVTCVVVDVSHEDPEVKFNWYVDGVEVHNAKTKP
REEQYNSTYRWSVLTVLHQDWLNGKEYKCKVSNKALPAPIEKTISKAKGQPREPQVYTLPPSRDELT
KNQVSLTCLVKGFYPSDIAVEWESNGQPENNYKTTPPVLDSDGSFFLYSKLTVDKSRWQQGNVFSC
SVMHEALHNHYTQKSLSLSPGK[GGGNGSGG]$_n$AMAEVQLLESGGGLVQPGGSLRLSCAASGFTFS
SYAMSWVRQAPGKGLEWVSSITAEGTHTWYADSVKGRFTISRDNSKNTLYLQMNSLRAEDTAVYY
CAKTSYRFDYWGQGTLVTVSSGGGGSGGGGSGGGGSTDIQMTQSPSSLSASVGDRVTITCRASQ
SISSYLNWYQQKPGKAPKLLIYKASRLQSGVPSRFSGSGSGTDFTLTISSLQPEDFATYYCQQKWDP
PRTFGQGTKVEIKRAAAHHHHHGAAEQKLISEEDLN;

[SEQ ID NO: 218]
(G) MXVPCVSGGLPKPANITFLSINMKNVLQWTPPEGLQGVKVTYTVQYFIYGQKKWLNKS
ECRNINRTYCDLSAETSDYEHQYYAKVKAIWGTKCSKWAESGRFYPFLETQIGPPEVALTTDEKSISV
VLTAPEKWKRNPEDLPVSMQQIYSNLKYNVSVLNTKSNRTWSQCVTNHTLVLTWLEPNTLYCVHVE
SFVPGPPRRAQPSEKQCARTLKDQSSEASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKT
HTCPPCPAPELLGGPSVFLFPPKPKDTLMISRTPEVTCVVVDVSHEDPEVKFNWYVDGVEVHNAKTKP
REEQYNSTYRWSVLTVLHQDWLNGKEYKCKVSNKALPAPIEKTISKAKGQPREPQVYTLPPSRDELT
KNQVSLTCLVKGFYPSDIAVEWESNGQPENNYKTTPPVLDSDGSFFLYSKLTVDKSRWQQGNVFSC
SVMHEALHNHYTQKSLSLSPGK[GGGCGGGG]$_n$AMAEVQLLESGGGLVQPGGSLRLSCAASGFTFS
SYAMSWVRQAPGKGLEWVSSITAEGTHTWYADSVKGRFTISRDNSKNTLYLQMNSLRAEDTAVYY
CAKTSYRFDYWGQGTLVTVSSGGGGSGGGGSGGGGSTDIQMTQSPSSLSASVGDRVTITCRASQ
SISSYLNWYQQKPGKAPKLLIYKASRLQSGVPSRFSGSGSGTDFTLTISSLQPEDFATYYCQQKWDP
PRTFGQGTKVEIKRAAAHHHHHGAAEQKLISEEDLN;

[SEQ ID NO: 219]
(H) MXVPCVSGGLPKPANITFLSINMKNVLQWTPPEGLQGVKVTYTVQYFIYGQKKWLNKS
ECRNINRTYCDLSAETSDYEHQYYAKVKAIWGTKCSKWAESGRFYPFLETQIGPPEVALTTDEKSISV
VLTAPEKWKRNPEDLPVSMQQIYSNLKYNVSVLNTKSNRTWSQCVTNHTLVLTWLEPNTLYCVHVE
SFVPGPPRRAQPSEKQCARTLKDQSSEASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKT
HTCPPCPAPELLGGPSVFLFPPKPKDTLMISRTPEVTCVVVDVSHEDPEVKFNWYVDGVEVHNAKTKP
REEQYNSTYRWSVLTVLHQDWLNGKEYKCKVSNKALPAPIEKTISKAKGQPREPQVYTLPPSRDELT
KNQVSLTCLVKGFYPSDIAVEWESNGQPENNYKTTPPVLDSDGSFFLYSKLTVDKSRWQQGNVFSC
SVMHEALHNHYTQKSLSLSPGK[GPNGG]$_n$AMAEVQLLESGGGLVQPGGSLRLSCAASGFTFSSYAM
SWVRQAPGKGLEWVSSITAEGTHTWYADSVKGRFTISRDNSKNTLYLQMNSLRAEDTAVYYCAKTS
YRFDYWGQGTLVTVSSGGGGSGGGGSGGGGSTDIQMTQSPSSLSASVGDRVTITCRASQSISSYL
NWYQQKPGKAPKLLIYKASRLQSGVPSRFSGSGSGTDFTLTISSLQPEDFATYYCQQKWDPPRTFG
QGTKVEIKRAAAHHHHHGAAEQKLISEEDLN;

-continued

[SEQ ID NO: 220]
(I) MXVPCVSGGLPKPANITFLSINMKNVLQWTPPEGLQGVKVTYTVQYFIYGQKKWLNKSE

*CRNINRTYCDLSAETSDYEHQYYAKVKAIWGTKCSKWAESGRFYPFLETQIGPPEVALTTDEKSISW*

*LTAPEKWKRNPEDLPVSMQQIYSNLKYNVSVLNTKSNRTWSQCVTNHTLVLTWLEPNTLYCVHVESF*

*VPGPPRRAQPSEKQCARTLKDQSSEASTKGPSVFPLAPSSKSTSGGTAALGCLVKDYFPEPVTVSWN*

*SGALTSGVHTFPAVLQSSGLYSLSSVVTVPSSSLGTQTYICNVNHKPSNTKVDKKVEPKSCDKTHTC*

*PPCPAPELLGGPSVFLFPPKPKDTLMISRTPEVTCVVVDVSHEDPEVKFNWYVDGVEVHNAKTKPREE*

*QYNSTYRVVSVLTVLHQDWLNGKEYKCKVSNKALPAPIEKTISKAKGQPREPQVYTLPPSRDELTKN*

*QVSLTCLVKGFYPSDIAVEWESNGQPENNYKTTPPVLDSDGSFFLYSKLTVDKSRWQQGNVFSCSV*

*MHEALHNHYTQKSLSLSPGK*AMAEVQLLESGGGLVQPGGSLRLSCAASGFTFSSYAMSWVRQAPG

KGLEWVSSITAEGTHTWYADSVKGRFTISRDNSKNTLYLQMNSLRAEDTAVYYCAKTSYRFDYWGQ

GTLVTVSSGGGGSGGGGSGGGGSTDIQMTQSPSSLSASVGDRVTITCRASQSISSYLNWYQQKPG

KAPKLLIYKASRLQSGVPSRFSGSGSGTDFTLTISSLQPEDFATYYCQQKWDPPRTFGQGTKVEIKRA

AAHHHHHHGAAEQKLISEEDLN;
wherein:

[SEQ ID NO: 57]
AMAEVQLLESGGGLVQPGGSLRLSCAASGFTFSSYAMSWVRQAPGKGLEWVSSITAEGTH

TWYADSVKGRFTISRDNSKNTLYLQMNSLRAEDTAVYYCAKTSYRFDYWGQGTLVTVSSGGGGSG

GGGSGGGGSTDIQMTQSPSSLSASVGDRVTITCRASQSISSYLNWYQQKPGKAPKLLIYKASRLQS

GVPSRFSGSGSGTDFTLTISSLQPEDFATYYCQQKWDPPRTFGQGTKVEIKRAAAHHHHHGAAEQ

KLISEEDLN = β-cell specific scFv

Underlined Text is Flexible Linker;
Text in italics corresponds to an extracellular domain of IL-20RA fused to the heavy chain of IgGγ1;
n=1 or more, suitably 1, 2, 3, 4, 5, 6, 7, 8, 9 or 10;
X is an optional tag (e.g., FLAGS, His6) for purification, and
wherein the construct is contacted with an extracellular domain of IL-20RB fused to the human κ light chain, which comprises the sequence:

[SEQ ID NO: 199]
DEVAILPAPQNLSVLSTNMKHLLMWSPVIAPGETVYYSVEYQGEYESLYTSHIWIPSSWCSLTEGPEC

DVTDDITATVPYNLRVRATLGSQTSAWSILKHPFNRNSTILTRPGMEITKDGFHLVIELEDLGPQFEFL

VAYWRREPGAEEHVKMVRSGGIPVHLETMEPGAAYCVKAQTFVKAIGRYSAFSQTECVEVQGEATV

AAPSVFIFPPSDEQLKSGTASVVCLLNNFYPREAKVQWKVDNALQSGNSQESVTEQDSKDSTYSLS

STLTLSKADYEKHKVYACEVTHQGLSSPVTKSFNRGEC to form a heterodimer that binds IL-24, or

[SEQ ID NO: 221]
(J) MXAMAEVQLLESGGGLVQPGGSLRLSCAASGFTFSSYAMSWVRQAPGKGLEWVSSIT

AEGTHTWYADSVKGRFTISRDNSKNTLYLQMNSLRAEDTAVYYCAKTSYRFDYWGQGTLVTVSSGG

GGSGGGGSGGGGSTDIQMTQSPSSLSASVGDRVTITCRASQSISSYLNWYQQKPGKAPKLLIYKAS

RLQSGVPSRFSGSGSGTDFTLTISSLQPEDFATYYCQQKWDPPRTFGQGTKVEIKRAAAHHHHHG

AAEQKLISEEDLN [GGGGSGGGGSGGGGSGGGGS]$_n$*VPCVSGGLPKPANITFLSINMKNVLQWTPP*

*EGLQGVKVTYTVQYFIYGQKKWLNKSECRNINRTYCDLSAETSDYEHQYYAKVKAIWGTKCSKWAE*

*SGRFYPFLETQIGPPEVALTTDEKSISWLTAPEKWKRNPEDLPVSMQQIYSNLKYNVSVLNTKSNRT*

-continued

WSQCVTNHTLVLTWLEPNTLYCVHVESFVPGPPRRAQPSEKQCARTLKDQSSEASTKGPSVFPLAPS
SKSTSGGTAALGCLVKDYFPEPVTVSWNSGALTSGVHTFPAVLQSSGLYSLSSVVTVPSSSLGTQTY
ICNVNHKPSNTKVDKKVEPKSCDKTHTCPPCPAPELLGGPSVFLFPPKPKDTLMISRTPEVTCVVVDV
SHEDPEVKFNWYVDGVEVHNAKTKPREEQYNSTYRWSVLTVLHQDWLNGKEYKCKVSNKALPAPI
EKTISKAKGQPREPQVYTLPPSRDELTKNQVSLTCLVKGFYPSDIAVEWESNGQPENNYKTTPPVLDS
DGSFFLYSKLTVDKSRWQQGNVFSCSVMHEALHNHYTQKSLSLSPGK;

[SEQ ID NO: 222]
(K) MXAMAEVQLLESGGGLVQPGGSLRLSCAASGFTFSSYAMSWVRQAPGKGLEWVSSIT
AEGTHTWYADSVKGRFTISRDNSKNTLYLQMNSLRAEDTAVYYCAKTSYRFDYWGQGTLVTVSSGG
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHG
AAEQKLISEEDLN [GGGSGGGS]<sub>n</sub> VPCVSGGLPKPANITFLSINMKNVLQWTPPEGLQGVKVTYTVQY
FIYGQKKWLNKSECRNINRTYCDLSAETSDYEHQYYAKVKAIWGTKCSKWAESGRFYPFLETQIGPP
EVALTTDEKSISWLTAPEKWKRNPEDLPVSMQQIYSNLKYNVSVLNTKSNRTWSQCVTNHTLVLTW
LEPNTLYCVHVESFVPGPPRRAQPSEKQCARTLKDQSSEASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDK
KVEPKSCDKTHTCPPCPAPELLGGPSVFLFPPKPKDTLMISRTPEVTCVWDVSHEDPEVKFNWYVDG
VEVHNAKTKPREEQYNSTYRVVSVLTVLHQDWLNGKEYKCKVSNKALPAPIEKTISKAKGQPREPQV
YTLPPSRDELTKNQVSLTCLVKGFYPSDIAVEWESNGQPENNYKTTPPVLDSDGSFFLYSKLTVDKSR
WQQGNVFSCSVMHEALHNHYTQKSLSLSPGK;

[SEQ ID NO: 223]
(L) MXAMAEVQLLESGGGLVQPGGSLRLSCAASGFTFSSYAMSWVRQAPGKGLEWVSSIT
AEGTHTWYADSVKGRFTISRDNSKNTLYLQMNSLRAEDTAVYYCAKTSYRFDYWGQGTLVTVSSGG
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHG
AAEQKLISEEDLN [GGGG]<sub>n</sub> VPCVSGGLPKPANITFLSINMKNVLQWTPPEGLQGVKVTYTVQYFIYG
QKKWLNKSECRNINRTYCDLSAETSDYEHQYYAKVKAIWGTKCSKWAESGRFYPFLETQIGPPEVAL
TTDEKSISWLTAPEKWKRNPEDLPVSMQQIYSNLKYNVSVLNTKSNRTWSQCVTNHTLVLTWLEPN
TLYCVHVESFVPGPPRRAQPSEKQCARTLKDQSSEASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVE
PKSCDKTHTCPPCPAPELLGGPSVFLFPPKPKDTLMISRTPEVTCVWDVSHEDPEVKFNWYVDGVEV
HNAKTKPREEQYNSTYRVVSVLTVLHQDWLNGKEYKCKVSNKALPAPIEKTISKAKGQPREPQVYTL
PPSRDELTKNQVSLTCLVKGFYPSDIAVEWESNGQPENNYKTTPPVLDSDGSFFLYSKLTVDKSRWQ
QGNVFSCSVMHEALHNHYTQKSLSLSPGK;

[SEQ ID NO: 224]
(M) MXAMAEVQLLESGGGLVQPGGSLRLSCAASGFTFSSYAMSWVRQAPGKGLEWVSSIT
AEGTHTWYADSVKGRFTISRDNSKNTLYLQMNSLRAEDTAVYYCAKTSYRFDYWGQGTLVTVSSGG
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHG
AAEQKLISEEDLN [GGGGG]<sub>n</sub> VPCVSGGLPKPANITFLSINMKNVLQWTPPEGLQGVKVTYTVQYFIY
GQKKWLNKSECRNINRTYCDLSAETSDYEHQYYAKVKAIWGTKCSKWAESGRFYPFLETQIGPPEV
ALTTDEKSISWLTAPEKWKRNPEDLPVSMQQIYSNLKYNVSVLNTKSNRTWSQCVTNHTLVLTWLE -continued PNTLYCVHVESFVPGPPRRAQPSEKQCARTLKDQSSEASTKGPSVFPLAPSSKSTSGGTAALGCLVK
DYFPEPVTVSWNSGALTSGVHTFPAVLQSSGLYSLSSWTVPSSSLGTQTYICNVNHKPSNTKVDKK
VEPKSCDKTHTCPPCPAPELLGGPSVFLFPPKPKDTLMISRTPEVTCVWDVSHEDPEVKFNWYVDGV
EVHNAKTKPREEQYNSTYRVVSVLTVLHQDWLNGKEYKCKVSNKALPAPIEKTISKAKGQPREPQVY
TLPPSRDELTKNQVSLTCLVKGFYPSDIAVEWESNGQPENNYKTTPPVLDSDGSFFLYSKLTVDKSR
WQQGNVFSCSVMHEALHNHYTQKSLSLSPGK;

[SEQ ID NO: 225]
(N) MXAMAEVQLLESGGGLVQPGGSLRLSCAASGFTFSSYAMSWVRQAPGKGLEWVSSIT
AEGTHTWYADSVKGRFTISRDNSKNTLYLQMNSLRAEDTAVYYCAKTSYRFDYWGQGTLVTVSSGG
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHG
AAEQKLISEEDLN [GGGKGGGG]ₙVPCVSGGLPKPANITFLSINMKNVLQWTPPEGLQGVKVTYTVQ
YFIYGQKKWLNKSECRNINRTYCDLSAETSDYEHQYYAKVKAIWGTKCSKWAESGRFYPFLETQIGP
PEVALTTDEKSISWLTAPEKWKRNPEDLPVSMQQIYSNLKYNVSVLNTKSNRTWSQCVTNHTLVLT
WLEPNTLYCVHVESFVPGPPRRAQPSEKQCARTLKDQSSEASTKGPSVFPLAPSSKSTSGGTAALGC
LVKDYFPEPVTVSWNSGALTSGVHTFPAVLQSSGLYSLSSVVTVPSSSLGTQTYICNVNHKPSNTKV
DKKVEPKSCDKTHTCPPCPAPELLGGPSVFLFPPKPKDTLMISRTPEVTCVWDVSHEDPEVKFNWYV
DGVEVHNAKTKPREEQYNSTYRVVSVLTVLHQDWLNGKEYKCKVSNKALPAPIEKTISKAKGQPREP
QVYTLPPSRDELTKNQVSLTCLVKGFYPSDIAVEWESNGQPENNYKTTPPVLDSDGSFFLYSKLTVDK
SRWQQGNVFSCSVMHEALHNHYTQKSLSLSPGK;

[SEQ ID NO: 226]
(O) MXAMAEVQLLESGGGLVQPGGSLRLSCAASGFTFSSYAMSWVRQAPGKGLEWVSSIT
AEGTHTWYADSVKGRFTISRDNSKNTLYLQMNSLRAEDTAVYYCAKTSYRFDYWGQGTLVTVSSGG
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHG
AAEQKLISEEDLN [GGGNGSGG]ₙVPCVSGGLPKPANITFLSINMKNVLQWTPPEGLQGVKVTYTVQY
FIYGQKKWLNKSECRNINRTYCDLSAETSDYEHQYYAKVKAIWGTKCSKWAESGRFYPFLETQIGPP
EVALTTDEKSISWLTAPEKWKRNPEDLPVSMQQIYSNLKYNVSVLNTKSNRTWSQCVTNHTLVLTW
LEPNTLYCVHVESFVPGPPRRAQPSEKQCARTLKDQSSEASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDK
KVEPKSCDKTHTCPPCPAPELLGGPSVFLFPPKPKDTLMISRTPEVTCVWDVSHEDPEVKFNWYVDG
VEVHNAKTKPREEQYNSTYRVVSVLTVLHQDWLNGKEYKCKVSNKALPAPIEKTISKAKGQPREPQV
YTLPPSRDELTKNQVSLTCLVKGFYPSDIAVEWESNGQPENNYKTTPPVLDSDGSFFLYSKLTVDKSR
WQQGNVFSCSVMHEALHNHYTQKSLSLSPGK;

[SEQ ID NO: 227]
(P) MXAMAEVQLLESGGGLVQPGGSLRLSCAASGFTFSSYAMSWVRQAPGKGLEWVSSIT
AEGTHTWYADSVKGRFTISRDNSKNTLYLQMNSLRAEDTAVYYCAKTSYRFDYWGQGTLVTVSSGG
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHG
AAEQKLISEEDLN [GGGCGGGG]ₙVPCVSGGLPKPANITFLSINMKNVLQWTPPEGLQGVKVTYTVQ
YFIYGQKKWLNKSECRNINRTYCDLSAETSDYEHQYYAKVKAIWGTKCSKWAESGRFYPFLETQIGP
PEVALTTDEKSISWLTAPEKWKRNPEDLPVSMQQIYSNLKYNVSVLNTKSNRTWSQCVTNHTLVLT

-continued

WLEPNTLYCVHVESFVPGPPRRAQPSEKQCARTLKDQSSEASTKGPSVFPLAPSSKSTSGGTAALGC

LVKDYFPEPVTVSWNSGALTSGVHTFPAVLQSSGLYSLSSVVTVPSSSLGTQTYICNVNHKPSNTKV

DKKVEPKSCDKTHTCPPCPAPELLGGPSVFLFPPKPKDTLMISRTPEVTCVWVDVSHEDPEVKFNWYV

DGVEVHNAKTKPREEQYNSTYRVVSVLTVLHQDWLNGKEYKCKVSNKALPAPIEKTISKAKGQPREP

QVYTLPPSRDELTKNQVSLTCLVKGFYPSDIAVEWESNGQPENNYKTTPPVLDSDGSFFLYSKLTVDK

SRWQQGNVFSCSVMHEALHNHYTQKSLSLSPGK;

[SEQ ID NO: 228]
(Q) MXAMAEVQLLESGGGLVQPGGSLRLSCAASGFTFSSYAMSWVRQAPGKGLEWVSSIT

AEGTHTWYADSVKGRFTISRDNSKNTLYLQMNSLRAEDTAVYYCAKTSYRFDYWGQGTLVTVSSGG

GGSGGGGSGGGGSTDIQMTQSPSSLSASVGDRVTITCRASQSISSYLNWYQQKPGKAPKLLIYKAS

RLQSGVPSRFSGSGSGTDFTLTISSLQPEDFATYYCQQKWDPPRTFGQGTKVEIKRAAAHHHHHHG

AAEQKLISEEDLN [GPNGG]$_n$VPCVSGGLPKPANITFLSINMKNVLQWTPPEGLQGVKVTYTVQYFIYG

QKKWLNKSECRNINRTYCDLSAETSDYEHQYYAKVKAIWGTKCSKWAESGRFYPFLETQIGPPEVAL

TTDEKSISWLTAPEKWKRNPEDLPVSMQQIYSNLKYNVSVLNTKSNRTWSQCVTNHTLVLTWLEPN

TLYCVHVESFVPGPPRRAQPSEKQCARTLKDQSSEASTKGPSVFPLAPSSKSTSGGTAALGCLVKDY

FPEPVTVSWNSGALTSGVHTFPAVLQSSGLYSLSSVVTVPSSSLGTQTYICNVNHKPSNTKVDKKVE

PKSCDKTHTCPPCPAPELLGGPSVFLFPPKPKDTLMISRTPEVTCVWDVSHEDPEVKFNWYVDGVEV

HNAKTKPREEQYNSTYRVVSVLTVLHQDWLNGKEYKCKVSNKALPAPIEKTISKAKGQPREPQVYTL

PPSRDELTKNQVSLTCLVKGFYPSDIAVEWESNGQPENNYKTTPPVLDSDGSFFLYSKLTVDKSRWQ

QGNVFSCSVMHEALHNHYTQKSLSLSPGK;

[SEQ ID NO: 229]
(R) MXAMAEVQLLESGGGLVQPGGSLRLSCAASGFTFSSYAMSWVRQAPGKGLEWVSSIT

AEGTHTWYADSVKGRFTISRDNSKNTLYLQMNSLRAEDTAVYYCAKTSYRFDYWGQGTLVTVSSGG

GGSGGGGSGGGGSTDIQMTQSPSSLSASVGDRVTITCRASQSISSYLNWYQQKPGKAPKLLIYKAS

RLQSGVPSRFSGSGSGTDFTLTISSLQPEDFATYYCQQKWDPPRTFGQGTKVEIKRAAAHHHHHHG

AAEQKLISEEDLNVPCVSGGLPKPANITFLSINMKNVLQWTPPEGLQGVKVTYTVQYFIYGQKKWLN

KSECRNINRTYCDLSAETSDYEHQYYAKVKAIWGTKCSKWAESGRFYPFLETQIGPPEVALTTDEKSI

SWLTAPEKWKRNPEDLPVSMQQIYSNLKYNVSVLNTKSNRTWSQCVTNHTLVLTWLEPNTLYCVH

VESFVPGPPRRAQPSEKQCARTLKDQSSEASTKGPSVFPLAPSSKSTSGGTAALGCLVKDYFPEPVTV

SWNSGALTSGVHTFPAVLQSSGLYSLSSWTVPSSSLGTQTYICNVNHKPSNTKVDKKVEPKSCDKT

HTCPPCPAPELLGGPSVFLFPPKPKDTLMISRTPEVTCVWDVSHEDPEVKFNWYVDGVEVHNAKTKP

REEQYNSTYRVVSVLTVLHQDWLNGKEYKCKVSNKALPAPIEKTISKAKGQPREPQVYTLPPSRDELT

KNQVSLTCLVKGFYPSDIAVEWESNGQPENNYKTTPPVLDSDGSFFLYSKLTVDKSRWQQGNVFSC

SVMHEALHNHYTQKSLSLSPGK;
wherein:

[SEQ ID NO: 57]
AMAEVQLLESGGGLVQPGGSLRLSCAASGFTFSSYAMSWVRQAPGKGLEWVSSITAEGTH

TWYADSVKGRFTISRDNSKNTLYLQMNSLRAEDTAVYYCAKTSYRFDYWGQGTLVTVSSGGGGSG

-continued

GGGSGGGGSTDIQMTQSPSSLSASVGDRVTITCRASQSISSYLNWYQQKPGKAPKLLIYKASRLQS

GVPSRFSGSGSGTDFTLTISSLQPEDFATYYCQQKWDPPRTFGQGTKVEIKRAAAHHHHHHGAAEQ

KLISEEDLN = β-cell specific scFv

Underlined Text is Flexible Linker;

Text in italics corresponds to an extracellular domain of IL-20RA fused to the heavy chain of IgGγ1;

n=1 or more, suitably 1, 2, 3, 4, 5, 6, 7, 8, 9 or 10;

X is an optional tag (e.g., FLAGS, His6) for purification, and wherein the construct is contacted with an extracellular domain of IL-20RB fused to the human κ light chain, which comprises the sequence:

[SEQ ID NO: 199]

DEVAILPAPQNLSVLSTNMKHLLMWSPVIAPGETVYYSVEYQGEYESLYTSHIWIPSSWCSLTEGPEC

DVTDDITATVPYNLRVRATLGSQTSAWSILKHPFNRNSTILTRPGMEITKDGFHLVIELEDLGPQFEFL

VAYWRREPGAEEHVKMVRSGGIPVHLETMEPGAAYCVKAQTFVKAIGRYSAFSQTECVEVQGEATV

AAPSVFIFPPSDEQLKSGTASVVCLLNNFYPREAKVQWKVDNALQSGNSQESVTEQDSKDSTYSLS

STLTLSKADYEKHKVYACEVTHQGLSSPVTKSFNRGEC to form a heterodimer that binds IL-24, or

[SEQ ID NO: 230]

(S) MX*DEVAILPAPQNLSVLSTNMKHLLMWSPVIAPGETVYYSVEYQGEYESLYTSHIWIPS*

*SWCSLTEGPECDVTDDITATVPYNLRVRATLGSQTSAWSILKHPFNRNSTILTRPGMEITKDGFHLVI*

*ELEDLGPQFEFLVAYWRREPGAEEHVKMVRSGGIPVHLETMEPGAAYCVKAQTFVKAIGRYSAFSQT*

*ECVEVQGEATVAAPSVFIFPPSDEQLKSGTASVVCLLNNFYPREAKVQWKVDNALQSGNSQESVTE*

*QDSKDSTYSLSSTLTLSKADYEKHKVYACEVTHQGLSSPVTKSFNRGEC*[GGGGSGGGGSGGGGS

GGGGS]$_n$AMAEVQLLESGGGLVQPGGSLRLSCAASGFTFSSYAMSWVRQAPGKGLEWVSSITAEGT

HTWYADSVKGRFTISRDNSKNTLYLQMNSLRAEDTAVYYCAKTSYRFDYWGQGTLVTVSSGGGGS

GGGGSGGGGSTDIQMTQSPSSLSASVGDRVTITCRASQSISSYLNWYQQKPGKAPKLLIYKASRLQ

SGVPSRFSGSGSGTDFTLTISSLQPEDFATYYCQQKWDPPRTFGQGTKVEIKRAAAHHHHHHGAAE

QKLISEEDLN;

[SEQ ID NO: 231]

(T) MX*DEVAILPAPQNLSVLSTNMKHLLMWSPVIAPGETVYYSVEYQGEYESLYTSHIWIPS*

*SWCSLTEGPECDVTDDITATVPYNLRVRATLGSQTSAWSILKHPFNRNSTILTRPGMEITKDGFHLVI*

*ELEDLGPQFEFLVAYWRREPGAEEHVKMVRSGGIPVHLETMEPGAAYCVKAQTFVKAIGRYSAFSQT*

*ECVEVQGEATVAAPSVFIFPPSDEQLKSGTASVVCLLNNFYPREAKVQWKVDNALQSGNSQESVTE*

*QDSKDSTYSLSSTLTLSKADYEKHKVYACEVTHQGLSSPVTKSFNRGEC*[GGGSGGGS]$_n$AMAEVQL

LESGGGLVQPGGSLRLSCAASGFTFSSYAMSWVRQAPGKGLEWVSSITAEGTHTWYADSVKGRFTI

SRDNSKNTLYLQMNSLRAEDTAVYYCAKTSYRFDYWGQGTLVTVSSGGGGSGGGGSGGGGSTDI

QMTQSPSSLSASVGDRVTITCRASQSISSYLNWYQQKPGKAPKLLIYKASRLQSGVPSRFSGSGSG

TDFTLTISSLQPEDFATYYCQQKWDPPRTFGQGTKVEIKRAAAHHHHHHGAAEQKLISEEDLN;

[SEQ ID NO: 232]

(U) MX*DEVAILPAPQNLSVLSTNMKHLLMWSPVIAPGETVYYSVEYQGEYESLYTSHIWIPS*

*SWCSLTEGPECDVTDDITATVPYNLRVRATLGSQTSAWSILKHPFNRNSTILTRPGMEITKDGFHLVI*

*ELEDLGPQFEFLVAYWRREPGAEEHVKMVRSGGIPVHLETMEPGAAYCVKAQTFVKAIGRYSAFSQT*

*ECVEVQGEATVAAPSVFIFPPSDEQLKSGTASVVCLLNNFYPREAKVQWKVDNALQSGNSQESVTE*

QDSKDSTYSLSSTLTLSKADYEKHKVYACEVTHQGLSSPVTKSFNRGEC[GGGG]ₙAMAEVQLLESG

GGLVQPGGSLRLSCAASGFTFSSYAMSWVRQAPGKGLEWVSSITAEGTHTWYADSVKGRFTISRD

NSKNTLYLQMNSLRAEDTAVYYCAKTSYRFDYWGQGTLVTVSSGGGGSGGGGSGGGGSTDIQMT

QSPSSLSASVGDRVTITCRASQSISSYLNWYQQKPGKAPKLLIYKASRLQSGVPSRFSGSGSGTDFT

LTISSLQPEDFATYYCQQKWDPPRTFGQGTKVEIKRAAAHHHHHGAAEQKLISEEDLN;

[SEQ ID NO: 233]

(V) MXDEVAILPAPQNLSVLSTNMKHLLMWSPVIAPGETVYYSVEYQGEYESLYTSHIWIPS

SWCSLTEGPECDVTDDITATVPYNLRVRATLGSQTSAWSILKHPFNRNSTILTRPGMEITKDGFHLVI

ELEDLGPQFEFLVAYWRREPGAEEHVKMVRSGGIPVHLETMEPGAAYCVKAQTFVKAIGRYSAFSQT

ECVEVQGEATVAAPSVFIFPPSDEQLKSGTASVVCLLNNFYPREAKVQWKVDNALQSGNSQESVTE

QDSKDSTYSLSSTLTLSKADYEKHKVYACEVTHQGLSSPVTKSFNRGEC[GGGGG]ₙAMAEVQLLES

GGGLVQPGGSLRLSCAASGFTFSSYAMSWVRQAPGKGLEWVSSITAEGTHTWYADSVKGRFTISR

DNSKNTLYLQMNSLRAEDTAVYYCAKTSYRFDYWGQGTLVTVSSGGGGSGGGGSGGGGSTDIQM

TQSPSSLSASVGDRVTITCRASQSISSYLNWYQQKPGKAPKLLIYKASRLQSGVPSRFSGSGSGTDF

TLTISSLQPEDFATYYCQQKWDPPRTFGQGTKVEIKRAAAHHHHHGAAEQKLISEEDLN;

[SEQ ID NO: 234]

(W) MXDEVAILPAPQNLSVLSTNMKHLLMWSPVIAPGETVYYSVEYQGEYESLYTSHIWIPS

SWCSLTEGPECDVTDDITATVPYNLRVRATLGSQTSAWSILKHPFNRNSTILTRPGMEITKDGFHLVI

ELEDLGPQFEFLVAYWRREPGAEEHVKMVRSGGIPVHLETMEPGAAYCVKAQTFVKAIGRYSAFSQT

ECVEVQGEATVAAPSVFIFPPSDEQLKSGTASVVCLLNNFYPREAKVQWKVDNALQSGNSQESVTE

QDSKDSTYSLSSTLTLSKADYEKHKVYACEVTHQGLSSPVTKSFNRGEC[GGGKGGGG]ₙAMAEVQL

LESGGGLVQPGGSLRLSCAASGFTFSSYAMSWVRQAPGKGLEWVSSITAEGTHTWYADSVKGRFTI

SRDNSKNTLYLQMNSLRAEDTAVYYCAKTSYRFDYWGQGTLVTVSSGGGGSGGGGSGGGGSTDI

QMTQSPSSLSASVGDRVTITCRASQSISSYLNWYQQKPGKAPKLLIYKASRLQSGVPSRFSGSGSG

TDFTLTISSLQPEDFATYYCQQKWDPPRTFGQGTKVEIKRAAAHHHHHGAAEQKLISEEDLN;

[SEQ ID NO: 235]

(X) MXDEVAILPAPQNLSVLSTNMKHLLMWSPVIAPGETVYYSVEYQGEYESLYTSHIWIPS

SWCSLTEGPECDVTDDITATVPYNLRVRATLGSQTSAWSILKHPFNRNSTILTRPGMEITKDGFHLVI

ELEDLGPQFEFLVAYWRREPGAEEHVKMVRSGGIPVHLETMEPGAAYCVKAQTFVKAIGRYSAFSQT

ECVEVQGEATVAAPSVFIFPPSDEQLKSGTASVVCLLNNFYPREAKVQWKVDNALQSGNSQESVTE

QDSKDSTYSLSSTLTLSKADYEKHKVYACEVTHQGLSSPVTKSFNRGEC[GGGNGSGG]ₙAMAEVQL

LESGGGLVQPGGSLRLSCAASGFTFSSYAMSWVRQAPGKGLEWVSSITAEGTHTWYADSVKGRFTI

SRDNSKNTLYLQMNSLRAEDTAVYYCAKTSYRFDYWGQGTLVTVSSGGGGSGGGGSGGGGSTDI

QMTQSPSSLSASVGDRVTITCRASQSISSYLNWYQQKPGKAPKLLIYKASRLQSGVPSRFSGSGSG

TDFTLTISSLQPEDFATYYCQQKWDPPRTFGQGTKVEIKRAAAHHHHHGAAEQKLISEEDLN;

[SEQ ID NO: 236]

(Y) MXDEVAILPAPQNLSVLSTNMKHLLMWSPVIAPGETVYYSVEYQGEYESLYTSHIWIPS

SWCSLTEGPECDVTDDITATVPYNLRVRATLGSQTSAWSILKHPFNRNSTILTRPGMEITKDGFHLVI

ELEDLGPQFEFLVAYWRREPGAEEHVKMVRSGGIPVHLETMEPGAAYCVKAQTFVKAIGRYSAFSQT

ECVEVQGEATVAAPSVFIFPPSDEQLKSGTASVVCLLNNFYPREAKVQWKVDNALQSGNSQESVTE

QDSKDSTYSLSSTLTLSKADYEKHKVYACEVTHQGLSSPVTKSFNRGEC[GGGCGGGG]ₙAMAEVQL

LESGGGLVQPGGSLRLSCAASGFTFSSYAMSWVRQAPGKGLEWVSSITAEGTHTWYADSVKGRFTI

SRDNSKNTLYLQMNSLRAEDTAVYYCAKTSYRFDYWGQGTLVTVSSGGGGSGGGGSGGGGSTDI

-continued

QMTQSPSSLSASVGDRVTITCRASQSISSYLNWYQQKPGKAPKLLIYKASRLQSGVPSRFSGSGSG

TDFTLTISSLQPEDFATYYCQQKWDPPRTFGQGTKVEIKRAAAHHHHHHGAAEQKLISEEDLN;

[SEQ ID NO: 237]
(Z) MXDEVAILPAPQNLSVLSTNMKHLLMWSPVIAPGETVYYSVEYQGEYESLYTSHIWIPS

SWCSLTEGPECDVTDDITATVPYNLRVRATLGSQTSAWSILKHPFNRNSTILTRPGMEITKDGFHLVI

ELEDLGPQFEFLVAYWRREPGAEEHVKMVRSGGIPVHLETMEPGAAYCVKAQTFVKAIGRYSAFSQT

ECVEVQGEATVAAPSVFIFPPSDEQLKSGTASVVCLLNNFYPREAKVQWKVDNALQSGNSQESVTE

QDSKDSTYSLSSTLTLSKADYEKHKVYACEVTHQGLSSPVTKSFNRGEC[GPNGG]ₙAMAEVQLLES

GGGLVQPGGSLRLSCAASGFTFSSYAMSWVRQAPGKGLEWVSSITAEGTHTWYADSVKGRFTISR

DNSKNTLYLQMNSLRAEDTAVYYCAKTSYRFDYWGQGTLVTVSSGGGGSGGGGSGGGGSTDIQM

TQSPSSLSASVGDRVTITCRASQSISSYLNWYQQKPGKAPKLLIYKASRLQSGVPSRFSGSGSGTDF

TLTISSLQPEDFATYYCQQKWDPPRTFGQGTKVEIKRAAAHHHHHHGAAEQKLISEEDLN;

[SEQ ID NO: 238]
(AA) MXDEVAILPAPQNLSVLSTNMKHLLMWSPVIAPGETVYYSVEYQGEYESLYTSHIWIP

SSWCSLTEGPECDVTDDITATVPYNLRVRATLGSQTSAWSILKHPFNRNSTILTRPGMEITKDGFHLV

IELEDLGPQFEFLVAYWRREPGAEEHVKMVRSGGIPVHLETMEPGAAYCVKAQTFVKAIGRYSAFSQ

TECVEVQGEATVAAPSVFIFPPSDEQLKSGTASVVCLLNNFYPREAKVQWKVDNALQSGNSQESVTE

QDSKDSTYSLSSTLTLSKADYEKHKVYACEVTHQGLSSPVTKSFNRGECAMAEVQLLESGGGLVQP

GGSLRLSCAASGFTFSSYAMSWVRQAPGKGLEWVSSITAEGTHTWYADSVKGRFTISRDNSKNTLY

LQMNSLRAEDTAVYYCAKTSYRFDYWGQGTLVTVSSGGGGSGGGGSGGGGSTDIQMTQSPSSLS

ASVGDRVTITCRASQSISSYLNWYQQKPGKAPKLLIYKASRLQSGVPSRFSGSGSGTDFTLTISSLQP

EDFATYYCQQKWDPPRTFGQGTKVEIKRAAAHHHHHHGAAEQKLISEEDLN;
wherein:

[SEQ ID NO: 57]
AMAEVQLLESGGGLVQPGGSLRLSCAASGFTFSSYAMSWVRQAPGKGLEWVSSITAEGTH

TWYADSVKGRFTISRDNSKNTLYLQMNSLRAEDTAVYYCAKTSYRFDYWGQGTLVTVSSGGGGSG

GGGSGGGGSTDIQMTQSPSSLSASVGDRVTITCRASQSISSYLNWYQQKPGKAPKLLIYKASRLQS

GVPSRFSGSGSGTDFTLTISSLQPEDFATYYCQQKWDPPRTFGQGTKVEIKRAAAHHHHHHGAAEQ

KLISEEDLN = β-cell specific scFv

Underlined Text is Flexible Linker;
Text in italics corresponds to an extracellular domain of IL-20RB fused to the human κ light chain;
n=1 or more, suitably 1, 2, 3, 4, 5, 6, 7, 8, 9 or 10;
X is an optional tag (e.g., FLAGS, His6) for purification, and
wherein the construct is contacted with an extracellular domain of IL-20RA fused to the heavy chain of IgGγ1, which comprises the sequence:

[SEQ ID NO: 198]
VPCVSGGLPKPANITFLSINMKNVLQWTPPEGLQGVKVTYTVQYFIYGQKKWLNKSECRNINRTYCD

LSAETSDYEHQYYAKVKAIWGTKCSKWAESGRFYPFLETQIGPPEVALTTDEKSISVVLTAPEKWKR

NPEDLPVSMQQIYSNLKYNVSVLNTKSNRTWSQCVTNHTLVLTWLEPNTLYCVHVESFVPGPPRRAQ

PSEKQCARTLKDQSSEASTKGPSVFPLAPSSKSTSGGTAALGCLVKDYFPEPVTVSWNSGALTSGVH

TFPAVLQSSGLYSLSSVVTVPSSSLGTQTYICNVNHKPSNTKVDKKVEPKSCDKTHTCPPCPAPELLG

GPSVFLFPPKPKDTLMISRTPEVTCVVVDVSHEDPEVKFNWYVDGVEVHNAKTKPREEQYNSTYRVV

-continued

SVLTVLHQDWLNGKEYKCKVSNKALPAPIEKTISKAKGQPREPQVYTLPPSRDELTKNQVSLTCLVKG

FYPSDIAVEWESNGQPENNYKTTPPVLDSDGSFFLYSKLTVDKSRWQQGNVFSCSVMHEALHNHYT

QKSLSLSPGK to form a heterodimer that binds IL-24, or

[SEQ ID NO: 239]

(AB) MXAMAEVQLLESGGGLVQPGGSLRLSCAASGFTFSSYAMSWVRQAPGKGLEWVSSI

TAEGTHTWYADSVKGRFTISRDNSKNTLYLQMNSLRAEDTAVYYCAKTSYRFDYWGQGTLVTVSSG

GGGSGGGGSGGGGSTDIQMTQSPSSLSASVGDRVTITCRASQSISSYLNWYQQKPGKAPKLLIYKA

SRLQSGVPSRFSGSGSGTDFTLTISSLQPEDFATYYCQQKWDPPRTFGQGTKVEIKRAAAHHHHHH

GAAEQKLISEEDLN[GGGGSGGGGSGGGGSGGGGS]*n*DEVAILPAPQNLSVLSTNMKHLLMWSPVI*
*APGETVYYSVEYQGEYESLYTSHIWIPSSWCSLTEGPECDVTDDITATVPYNLRVRATLGSQTSAWSI*
*LKHPFNRNSTILTRPGMEITKDGFHLVIELEDLGPQFEFLVAYWRREPGAEEHVKMVRSGGIPVHLET*
*MEPGAAYCVKAQTFVKAIGRYSAFSQTECVEVQGEATVAAPSVFIFPPSDEQLKSGTASVVCLLNNFY*
*PREAKVQWKVDNALQSGNSQESVTEQDSKDSTYSLSSTLTLSKADYEKHKVYACEVTHQGLSSPVT*
*KSFNRGEC*;

[SEQ ID NO: 240]
(AC) MXAMAEVQLLESGGGLVQPGGSLRLSCAASGFTFSSYAMSWVRQAPGKGLEWVSSI
TAEGTHTWYADSVKGRFTISRDNSKNTLYLQMNSLRAEDTAVYYCAKTSYRFDYWGQGTLVTVSSG
GGGSGGGGSGGGGSTDIQMTQSPSSLSASVGDRVTITCRASQSISSYLNWYQQKPGKAPKLLIYKA
SRLQSGVPSRFSGSGSGTDFTLTISSLQPEDFATYYCQQKWDPPRTFGQGTKVEIKRAAAHHHHHH
GAAEQKLISEEDLN[GGGSGGGS]$_n$*RDEVAILPAPQNLSVLSTNMKHLLMWSPVIAPGETVYYSVEYQG*
*EYESLYTSHIWIPSSWCSLTEGPECDVTDDITATVPYNLRVRATLGSQTSAWSILKHPFNRNSTILTR*
*PGMEITKDGFHLVIELEDLGPQFEFLVAYWRREPGAEEHVKMVRSGGIPVHLETMEPGAAYCVKAQT*
*FVKAIGRYSAFSQTECVEVQGEATVAAPSVFIFPPSDEQLKSGTASWCLLNNFYPREAKVQWKVDN*
*ALQSGNSQESVTEQDSKDSTYSLSSTLTLSKADYEKHKVYACEVTHQGLSSPVTKSFNRGEC*;

[SEQ ID NO: 241]
(AD) MXAMAEVQLLESGGGLVQPGGSLRLSCAASGFTFSSYAMSWVRQAPGKGLEWVSSI
TAEGTHTWYADSVKGRFTISRDNSKNTLYLQMNSLRAEDTAVYYCAKTSYRFDYWGQGTLVTVSSG
GGGSGGGGSGGGGSTDIQMTQSPSSLSASVGDRVTITCRASQSISSYLNWYQQKPGKAPKLLIYKA
SRLQSGVPSRFSGSGSGTDFTLTISSLQPEDFATYYCQQKWDPPRTFGQGTKVEIKRAAAHHHHHH
GAAEQKLISEEDLN[GGGG]$_n$*DEVAILPAPQNLSVLSTNMKHLLMWSPVIAPGETVYYSVEYQGEYES*
*LYTSHIWIPSSWCSLTEGPECDVTDDITATVPYNLRVRATLGSQTSAWSILKHPFNRNSTILTRPGME*
*ITKDGFHLVIELEDLGPQFEFLVAYWRREPGAEEHVKMVRSGGIPVHLETMEPGAAYCVKAQTFVKAI*
*GRYSAFSQTECVEVQGEATVAAPSVFIFPPSDEQLKSGTASWCLLNNFYPREAKVQWKVDNALQSG*
*NSQESVTEQDSKDSTYSLSSTLTLSKADYEKHKVYACEVTHQGLSSPVTKSFNRGEC*;

[SEQ ID NO: 242]
(AE) MXAMAEVQLLESGGGLVQPGGSLRLSCAASGFTFSSYAMSWVRQAPGKGLEWVSSI
TAEGTHTWYADSVKGRFTISRDNSKNTLYLQMNSLRAEDTAVYYCAKTSYRFDYWGQGTLVTVSSG
GGGSGGGGSGGGGSTDIQMTQSPSSLSASVGDRVTITCRASQSISSYLNWYQQKPGKAPKLLIYKA
SRLQSGVPSRFSGSGSGTDFTLTISSLQPEDFATYYCQQKWDPPRTFGQGTKVEIKRAAAHHHHHH
GAAEQKLISEEDLN[GGGGG]$_n$*DEVAILPAPQNLSVLSTNMKHLLMWSPVIAPGETVYYSVEYQGEYE*
*SLYTSHIWIPSSWCSLTEGPECDVTDDITATVPYNLRVRATLGSQTSAWSILKHPFNRNSTILTRPGM*
*EITKDGFHLVIELEDLGPQFEFLVAYWRREPGAEEHVKMVRSGGIPVHLETMEPGAAYCVKAQTFVKA*

-continued

IGRYSAFSQTECVEVQGEATVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPVTKSFNRGEC;

[SEQ ID NO: 243]

(AF) MXAMAEVQLLESGGGLVQPGGSLRLSCAASGFTFSSYAMSWVRQAPGKGLEWVSSI
TAEGTHTWYADSVKGRFTISRDNSKNTLYLQMNSLRAEDTAVYYCAKTSYRFDYWGQGTLVTVSSG
GGGSGGGGSGGGGSTDIQMTQSPSSLSASVGDRVTITCRASQSISSYLNWYQQKPGKAPKLLIYKA
SRLQSGVPSRFSGSGSGTDFTLTISSLQPEDFATYYCQQKWDPPRTFGQGTKVEIKRAAAHHHHHH
GAAEQKLISEEDLN[GGGKGGGG]$_n$DEVAILPAPQNLSVLSTNMKHLLMWSPVIAPGETVYYSVEYQ
GEYESLYTSHIWIPSSWCSLTEGPECDVTDDITATVPYNLRVRATLGSQTSAWSILKHPFNRNSTILT
RPGMEITKDGFHLVIELEDLGPQFEFLVAYWRREPGAEEHVKMVRSGGIPVHLETMEPGAAYCVKAQ
TFVKAIGRYSAFSQTECVEVQGEATVAAPSVFIFPPSDEQLKSGTASWCLLNNFYPREAKVQWKVD
NALQSGNSQESVTEQDSKDSTYSLSSTLTLSKADYEKHKVYACEVTHQGLSSPVTKSFNRGEC;

[SEQ ID NO: 244]

(AG) MXAMAEVQLLESGGGLVQPGGSLRLSCAASGFTFSSYAMSWVRQAPGKGLEWVSSI
TAEGTHTWYADSVKGRFTISRDNSKNTLYLQMNSLRAEDTAVYYCAKTSYRFDYWGQGTLVTVSSG
GGGSGGGGSGGGGSTDIQMTQSPSSLSASVGDRVTITCRASQSISSYLNWYQQKPGKAPKLLIYKA
SRLQSGVPSRFSGSGSGTDFTLTISSLQPEDFATYYCQQKWDPPRTFGQGTKVEIKRAAAHHHHHH
GAAEQKLISEEDLN[GGGNGSGG]$_n$DEVAILPAPQNLSVLSTNMKHLLMWSPVIAPGETVYYSVEYQ
GEYESLYTSHIWIPSSWCSLTEGPECDVTDDITATVPYNLRVRATLGSQTSAWSILKHPFNRNSTILT
RPGMEITKDGFHLVIELEDLGPQFEFLVAYWRREPGAEEHVKMVRSGGIPVHLETMEPGAAYCVKAQ
TFVKAIGRYSAFSQTECVEVQGEATVAAPSVFIFPPSDEQLKSGTASWCLLNNFYPREAKVQWKVD
NALQSGNSQESVTEQDSKDSTYSLSSTLTLSKADYEKHKVYACEVTHQGLSSPVTKSFNRGEC;

[SEQ ID NO: 245]

(AH) MXAMAEVQLLESGGGLVQPGGSLRLSCAASGFTFSSYAMSWVRQAPGKGLEWVSSI
TAEGTHTWYADSVKGRFTISRDNSKNTLYLQMNSLRAEDTAVYYCAKTSYRFDYWGQGTLVTVSSG
GGGSGGGGSGGGGSTDIQMTQSPSSLSASVGDRVTITCRASQSISSYLNWYQQKPGKAPKLLIYKA
SRLQSGVPSRFSGSGSGTDFTLTISSLQPEDFATYYCQQKWDPPRTFGQGTKVEIKRAAAHHHHHH
GAAEQKLISEEDLN[GGGCGGGG]$_n$DEVAILPAPQNLSVLSTNMKHLLMWSPVIAPGETVYYSVEYQ
GEYESLYTSHIWIPSSWCSLTEGPECDVTDDITATVPYNLRVRATLGSQTSAWSILKHPFNRNSTILT
RPGMEITKDGFHLVIELEDLGPQFEFLVAYWRREPGAEEHVKMVRSGGIPVHLETMEPGAAYCVKAQ
TFVKAIGRYSAFSQTECVEVQGEATVAAPSVFIFPPSDEQLKSGTASWCLLNNFYPREAKVQWKVD
NALQSGNSQESVTEQDSKDSTYSLSSTLTLSKADYEKHKVYACEVTHQGLSSPVTKSFNRGEC;

[SEQ ID NO: 246]

(AI) MXAMAEVQLLESGGGLVQPGGSLRLSCAASGFTFSSYAMSWVRQAPGKGLEWVSSI
TAEGTHTWYADSVKGRFTISRDNSKNTLYLQMNSLRAEDTAVYYCAKTSYRFDYWGQGTLVTVSSG
GGGSGGGGSGGGGSTDIQMTQSPSSLSASVGDRVTITCRASQSISSYLNWYQQKPGKAPKLLIYKA
SRLQSGVPSRFSGSGSGTDFTLTISSLQPEDFATYYCQQKWDPPRTFGQGTKVEIKRAAAHHHHHH
GAAEQKLISEEDLNP[GPNGG]$_n$DEVAILPAPQNLSVLSTNMKHLLMWSPVIAPGETVYYSVEYQGEYE
SLYTSHIWIPSSWCSLTEGPECDVTDDITATVPYNLRVRATLGSQTSAWSILKHPFNRNSTILTRPGM

```
EITKDGFHLVIELEDLGPQFEFLVAYWRREPGAEEHVKMVRSGGIPVHLETMEPGAAYCVKAQTFVKA

IGRYSAFSQTECVEVQGEATVAAPSVFIFPPSDEQLKSGTASVVCLLNNFYPREAKVQWKVDNALQS

GNSQESVTEQDSKDSTYSLSSTLTLSKADYEKHKVYACEVTHQGLSSPVTKSFNRGEC;
```

[SEQ ID NO: 247]
```
(AJ) MXAMAEVQLLESGGGLVQPGGSLRLSCAASGFTFSSYAMSWVRQAPGKGLEWVSSI

TAEGTHTWYADSVKGRFTISRDNSKNTLYLQMNSLRAEDTAVYYCAKTSYRFDYWGQGTLVTVSSG

GGGSGGGGSGGGGSTDIQMTQSPSSLSASVGDRVTITCRASQSISSYLNWYQQKPGKAPKLLIYKA

SRLQSGVPSRFSGSGSGTDFTLTISSLQPEDFATYYCQQKWDPPRTFGQGTKVEIKRAAAHHHHHH

GAAEQKLISEEDLNDEVAILPAPQNLSVLSTNMKHLLMWSPVIAPGETVYYSVEYQGEYESLYTSHIW

IPSSWCSLTEGPECDVTDDITATVPYNLRVRATLGSQTSAWSILKHPFNRNSTILTRPGMEITKDGFH

LVIELEDLGPQFEFLVAYWRREPGAEEHVKMVRSGGIPVHLETMEPGAAYCVKAQTFVKAIGRYSAFS

QTECVEVQGEATVAAPSVFIFPPSDEQLKSGTASWCLLNNFYPREAKVQWKVDNALQSGNSQESV

TEQDSKDSTYSLSSTLTLSKADYEKHKVYACEVTHQGLSSPVTKSFNRGEC;
wherein:
```

[SEQ ID NO: 57]
```
AMAEVQLLESGGGLVQPGGSLRLSCAASGFTFSSYAMSWVRQAPGKGLEWVSSITAEGTH

TWYADSVKGRFTISRDNSKNTLYLQMNSLRAEDTAVYYCAKTSYRFDYWGQGTLVTVSSGGGGSG

GGGSGGGGSTDIQMTQSPSSLSASVGDRVTITCRASQSISSYLNWYQQKPGKAPKLLIYKASRLQS

GVPSRFSGSGSGTDFTLTISSLQPEDFATYYCQQKWDPPRTFGQGTKVEIKRAAAHHHHHGAAEQ

KLISEEDLN = β-cell specific scFv
```

Underlined Text is Flexible Linker;

Text in italics corresponds to an extracellular domain of IL-20RB fused to the human κ light chain;

n=1 or more, suitably 1, 2, 3, 4, 5, 6, 7, 8, 9 or 10;

X is an optional tag (e.g., FLAGS, His6) for purification, and wherein the construct is contacted with an extracellular domain of IL-20RA fused to the heavy chain of IgGγ1, which comprises the sequence:

[SEQ ID NO: 198]
```
VPCVSGGLPKPANITFLSINMKNVLQWTPPEGLQGVKVTYTVQYFIYGQ

KKWLNKSECRNINRTYCDLSAETSDYEHQYYAKVKAIWGTKCSKWAESG

RFYPPFLETQIGPPEVALTTDEKSISVVLTAPEKWKRNPEDLPVSMQQIY

SNLKYNVSVLNTKSNRTWSQCVTNHTLVLTWLEPNTLYCVHVESFVPGP

PRRAQPSEKQCARTLKDQSSEASTKGPSVFPLAPSSKSTSGGTAALGCL

VKDYFPEPVTVSWNSGALTSGVHTFPAVLQSSGLYSLSSVVTVPSSSLG

TQTYICNVNHKPSNTKVDKKVEPKSCDKTHTCPPCPAPELLGGPSVFLF

PPKPKDTLMISRTPEVTCVVVDVSHEDPEVKFNWYVDGVEVHNAKTKPR

EEQYNSTYRVVSVLTVLHQDWLNGKEYKCKVSNKALPAPIEKTISKAKG

QPREPQVYTLPPSRDELTKNQVSLTCLVKGFYPSDIAVEWESNGQPENN

YKTTPPVLDSDGSFFLYSKLTVDKSRWQQGNVFSCSVMHEALHNHYTQK

SLSLSPGK to form a heterodimer that binds IL-24.
```

In still other embodiments, the OER stress inhibitor is an antigen-binding molecule that is immuno-interactive with IL-23 and the targeting agent is an antigen-binding molecule that is immuno-interactive with a β-cell surface binding protein as taught for example in WO 2010/096930. Non-limiting examples of constructs of this type include:

[SEQ ID NO: 248]
```
(A) MXQSVLTQPPSVSGAPGQRVTISCTGSSSNTGAGYDVHWYQQVPGTAPKLLIYGSGN

RPSGVPDRFSGSKSGTSASLAITGLQAEDEADYYCQSYDSSLSGWVFGGGTRLTVLGGGGSGGGG

SGGGGSQVQLVESGGGVVQPGRSLRLSCAASGFTFSSYGMHWVRQAPGKGLEWVAVIWYDGSNE

YYADSVKGRFTISRDNSKNTLYLQMNSLRAEDTAVYYCARDRGYTSSWYPDAFDIWGQGTMVTVSS

[GGGGSGGGGSGGGGSGGGGS]ₙAMAEVQLLESGGGLVQPGGSLRLSCAASGFTFSSYAMSWVR

QAPGKGLEWVSSITAEGTHTWYADSVKGRFTISRDNSKNTLYLQMNSLRAEDTAVYYCAKTSYRFD

YWGQGTLVTVSSGGGGSGGGGSGGGGSTDIQMTQSPSSLSASVGDRVTITCRASQSISSYLNWY
```

-continued

QQKPGKAPKLLIYKASRLQSGVPSRFSGSGSGTDFTLTISSLQPEDFATYYCQQKWDPPRTFGQGTK

VEIKRAAAHHHHHHGAAEQKLISEEDLN;

[SEQ ID NO: 249]

(B) MXQSVLTQPPSVSGAPGQRVTISCTGSSSNTGAGYDVHWYQQVPGTAPKLLIYGSGN

RPSGVPDRFSGSKSGTSASLAITGLQAEDEADYYCQSYDSSLSGWVFGGGTRLTVLGGGGSGGGG

SGGGGSQVQLVESGGGVVQPGRSLRLSCAASGFTFSSYGMHWVRQAPGKGLEWVAVIWYDGSNE

YYADSVKGRFTISRDNSKNTLYLQMNSLRAEDTAVYYCARDRGYTSSWYPDAFDIWGQGTMVTVSS

[GGGSGGGS]<sub>n</sub>AMAEVQLLESGGGLVQPGGSLRLSCAASGFTFSSYAMSWVRQAPGKGLEWVSSIT

AEGTHTWYADSVKGRFTISRDNSKNTLYLQMNSLRAEDTAVYYCAKTSYRFDYWGQGTLVTVSSGG

GGSGGGGSGGGGSTDIQMTQSPSSLSASVGDRVTITCRASQSISSYLNWYQQKPGKAPKLLIYKAS

RLQSGVPSRFSGSGSGTDFTLTISSLQPEDFATYYCQQKWDPPRTFGQGTKVEIKRAAAHHHHHG

AAEQKLISEEDLN;

[SEQ ID NO: 250]

(C) MXQSVLTQPPSVSGAPGQRVTISCTGSSSNTGAGYDVHWYQQVPGTAPKLLIYGSGN

RPSGVPDRFSGSKSGTSASLAITGLQAEDEADYYCQSYDSSLSGWVFGGGTRLTVLGGGGSGGGG

SGGGGSQVQLVESGGGVVQPGRSLRLSCAASGFTFSSYGMHWVRQAPGKGLEWVAVIWYDGSNE

YYADSVKGRFTISRDNSKNTLYLQMNSLRAEDTAVYYCARDRGYTSSWYPDAFDIWGQGTMVTVSS

[GGGG]<sub>n</sub>AMAEVQLLESGGGLVQPGGSLRLSCAASGFTFSSYAMSWVRQAPGKGLEWVSSITAEGT

HTWYADSVKGRFTISRDNSKNTLYLQMNSLRAEDTAVYYCAKTSYRFDYWGQGTLVTVSSGGGGS

GGGGSGGGGSTDIQMTQSPSSLSASVGDRVTITCRASQSISSYLNWYQQKPGKAPKLLIYKASRLQ

SGVPSRFSGSGSGTDFTLTISSLQPEDFATYYCQQKWDPPRTFGQGTKVEIKRAAAHHHHHGAAE

QKLISEEDLN;

[SEQ ID NO: 251]

(D) MXQSVLTQPPSVSGAPGQRVTISCTGSSSNTGAGYDVHWYQQVPGTAPKLLIYGSGN

RPSGVPDRFSGSKSGTSASLAITGLQAEDEADYYCQSYDSSLSGWVFGGGTRLTVLGGGGSGGGG

SGGGGSQVQLVESGGGVVQPGRSLRLSCAASGFTFSSYGMHWVRQAPGKGLEWVAVIWYDGSNE

YYADSVKGRFTISRDNSKNTLYLQMNSLRAEDTAVYYCARDRGYTSSWYPDAFDIWGQGTMVTVSS

[GGGGG]<sub>n</sub>AMAEVQLLESGGGLVQPGGSLRLSCAASGFTFSSYAMSWVRQAPGKGLEWVSSITAEG

THTWYADSVKGRFTISRDNSKNTLYLQMNSLRAEDTAVYYCAKTSYRFDYWGQGTLVTVSSGGGG

SGGGGSGGGGSTDIQMTQSPSSLSASVGDRVTITCRASQSISSYLNWYQQKPGKAPKLLIYKASRL

QSGVPSRFSGSGSGTDFTLTISSLQPEDFATYYCQQKWDPPRTFGQGTKVEIKRAAAHHHHHGAA

EQKLISEEDLN;

[SEQ ID NO: 252]

(E) MXQSVLTQPPSVSGAPGQRVTISCTGSSSNTGAGYDVHWYQQVPGTAPKLLIYGSGN

RPSGVPDRFSGSKSGTSASLAITGLQAEDEADYYCQSYDSSLSGWVFGGGTRLTVLGGGGSGGGG

SGGGGSQVQLVESGGGVVQPGRSLRLSCAASGFTFSSYGMHWVRQAPGKGLEWVAVIWYDGSNE

YYADSVKGRFTISRDNSKNTLYLQMNSLRAEDTAVYYCARDRGYTSSWYPDAFDIWGQGTMVTVSS

[GGGKGGGG]<sub>n</sub>AMAEVQLLESGGGLVQPGGSLRLSCAASGFTFSSYAMSWVRQAPGKGLEWVSSIT

AEGTHTWYADSVKGRFTISRDNSKNTLYLQMNSLRAEDTAVYYCAKTSYRFDYWGQGTLVTVSSGG

```
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHG
AAEQKLISEEDLN;
```

[SEQ ID NO: 253]

(F) MXQSVLTQPPSVSGAPGQRVTISCTGSSSNTGAGYDVHWYQQVPGTAPKLLIYGSGN
RPSGVPDRFSGSKSGTSASLAITGLQAEDEADYYCQSYDSSLSGWVFGGGTRLTVLGGGGSGGGG
SGGGGSQVQLVESGGGVVQPGRSLRLSCAASGFTFSSYGMHWVRQAPGKGLEWVAVIWYDGSNE
YYADSVKGRFTISRDNSKNTLYLQMNSLRAEDTAVYYCARDRGYTSSWYPDAFDIWGQGTMVTVSS
[GGGNGSGG]ₙAMAEVQLLESGGGLVQPGGSLRLSCAASGFTFSSYAMSWVRQAPGKGLEWVSSIT
AEGTHTWYADSVKGRFTISRDNSKNTLYLQMNSLRAEDTAVYYCAKTSYRFDYWGQGTLVTVSSGG
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHG
AAEQKLISEEDLN;

[SEQ ID NO: 254]

(G) MXQSVLTQPPSVSGAPGQRVTISCTGSSSNTGAGYDVHWYQQVPGTAPKLLIYGSGN
RPSGVPDRFSGSKSGTSASLAITGLQAEDEADYYCQSYDSSLSGWVFGGGTRLTVLGGGGSGGGG
SGGGGSQVQLVESGGGVVQPGRSLRLSCAASGFTFSSYGMHWVRQAPGKGLEWVAVIWYDGSNE
YYADSVKGRFTISRDNSKNTLYLQMNSLRAEDTAVYYCARDRGYTSSWYPDAFDIWGQGTMVTVSS
[GGGCGGGG]ₙAMAEVQLLESGGGLVQPGGSLRLSCAASGFTFSSYAMSWVRQAPGKGLEWVSSIT
AEGTHTWYADSVKGRFTISRDNSKNTLYLQMNSLRAEDTAVYYCAKTSYRFDYWGQGTLVTVSSGG
GGSGGGGSGGGGSTDIQMTQSPSSLSASVGDRVTITCRASQSISSYLNWYQQKPGKAPKLLIYKAS
RLQSGVPSRFSGSGSGTDFTLTISSLQPEDFATYYCQQKWDPPRTFGQGTKVEIKRAAAHHHHHG
AAEQKLISEEDLN;

[SEQ ID NO: 255]

(H) MXQSVLTQPPSVSGAPGQRVTISCTGSSSNTGAGYDVHWYQQVPGTAPKLLIYGSGN
RPSGVPDRFSGSKSGTSASLAITGLQAEDEADYYCQSYDSSLSGWVFGGGTRLTVLGGGGSGGGG
SGGGGSQVQLVESGGGVVQPGRSLRLSCAASGFTFSSYGMHWVRQAPGKGLEWVAVIWYDGSNE
YYADSVKGRFTISRDNSKNTLYLQMNSLRAEDTAVYYCARDRGYTSSWYPDAFDIWGQGTMVTVSS
[GPNGG]ₙAMAEVQLLESGGGLVQPGGSLRLSCAASGFTFSSYAMSWVRQAPGKGLEWVSSITAEG
THTWYADSVKGRFTISRDNSKNTLYLQMNSLRAEDTAVYYCAKTSYRFDYWGQGTLVTVSSGGGG
SGGGGSGGGGSTDIQMTQSPSSLSASVGDRVTITCRASQSISSYLNWYQQKPGKAPKLLIYKASRL
QSGVPSRFSGSGSGTDFTLTISSLQPEDFATYYCQQKWDPPRTFGQGTKVEIKRAAAHHHHHGAA
EQKLISEEDLN;

[SEQ ID NO: 256]

(I) MXQSVLTQPPSVSGAPGQRVTISCTGSSSNTGAGYDVHWYQQVPGTAPKLLIYGSGNR
PSGVPDRFSGSKSGTSASLAITGLQAEDEADYYCQSYDSSLSGWVFGGGTRLTVLGGGGSGGGGS
GGGGSQVQLVESGGGVVQPGRSLRLSCAASGFTFSSYGMHWVRQAPGKGLEWVAVIWYDGSNEY
YADSVKGRFTISRDNSKNTLYLQMNSLRAEDTAVYYCARDRGYTSSWYPDAFDIWGQGTMVTVSSA
MAEVQLLESGGGLVQPGGSLRLSCAASGFTFSSYAMSWVRQAPGKGLEWVSSITAEGTHTWYADS
VKGRFTISRDNSKNTLYLQMNSLRAEDTAVYYCAKTSYRFDYWGQGTLVTVSSGGGGSGGGGSGG
GGSTDIQMTQSPSSLSASVGDRVTITCRASQSISSYLNWYQQKPGKAPKLLIYKASRLQSGVPSRFS
GSGSGTDFTLTISSLQPEDFATYYCQQKWDPPRTFGQGTKVEIKRAAAHHHHHGAAEQKLISEEDL
N;

-continued wherein:

[SEQ ID NO: 57]
AMAEVQLLESGGGLVQPGGSLRLSCAASGFTFSSYAMSWVRQAPGKGLEWVSSITAEGTH
TWYADSVKGRFTISRDNSKNTLYLQMNSLRAEDTAVYYCAKTSYRFDYWGQGTLVTVSSGGGGSG
GGGSGGGGSTDIQMTQSPSSLSASVGDRVTITCRASQSISSYLNWYQQKPGKAPKLLIYKASRLQS
GVPSRFSGSGSGTDFTLTISSLQPEDFATYYCQQKWDPPRTFGQGTKVEIKRAAAHHHHHHGAAEQ
KLISEEDLN = β-cell specific scFv Underlined Text is Flexible Linker;
Text in italics is anti-IL23 scFv;
n=1 or more, suitably 1, 2, 3, 4, 5, 6, 7, 8, 9 or 10; and
X is an optional tag (e.g., FLAGS, His6) for purification, or

[SEQ ID NO: 257]
(J) MXAMAEVQLLESGGGLVQPGGSLRLSCAASGFTFSSYAMSWVRQAPGKGLEWVSSIT

AEGTHTWYADSVKGRFTISRDNSKNTLYLQMNSLRAEDTAVYYCAKTSYRFDYWGQGTLVTVSSGG

GGSGGGGSGGGGSTDIQMTQSPSSLSASVGDRVTITCRASQSISSYLNWYQQKPGKAPKLLIYKAS

RLQSGVPSRFSGSGSGTDFTLTISSLQPEDFATYYCQQKWDPPRTFGQGTKVEIKRAAAHHHHHHG

AAEQKLISEEDLN[GGGGSGGGGSGGGGSGGGGS]<sub>n</sub>*QSVLTQPPSVSGAPGQRVTISCTGSSSNTG*

*AGYDVHWYQQVPGTAPKLLIYGSGNRPSGVPDRFSGSKSGTSASLAITGLQAEDEADYYCQSYDSS*

*LSGWVFGGGTRLTVLGGGGSGGGGSGGGGSQVQLVESGGGWQPGRSLRLSCAASGFTFSSYGM*

*HWVRQAPGKGLEWVAVIWYDGSNEYYADSVKGRFTISRDNSKNTLYLQMNSLRAEDTAVYYCARD*

*RGYTSSWYPDAFDIWGQGTMVTVSS*;

[SEQ ID NO: 258]
(K) MXAMAEVQLLESGGGLVQPGGSLRLSCAASGFTFSSYAMSWVRQAPGKGLEWVSSIT

AEGTHTWYADSVKGRFTISRDNSKNTLYLQMNSLRAEDTAVYYCAKTSYRFDYWGQGTLVTVSSGG

GGSGGGGSGGGGSTDIQMTQSPSSLSASVGDRVTITCRASQSISSYLNWYQQKPGKAPKLLIYKAS

RLQSGVPSRFSGSGSGTDFTLTISSLQPEDFATYYCQQKWDPPRTFGQGTKVEIKRAAAHHHHHHG

AAEQKLISEEDLN[GGGSGGGS]<sub>n</sub>*QSVLTQPPSVSGAPGQRVTISCTGSSSNTGAGYDVHWYQQVP*

*GTAPKLLIYGSGNRPSGVPDRFSGSKSGTSASLAITGLQAEDEADYYCQSYDSSLSGWVFGGGTRLT*

*VLGGGGSGGGGSGGGGSQVQLVESGGGVVQPGRSLRLSCAASGFTFSSYGMHWVRQAPGKGLE*

*WVAVIWYDGSNEYYADSVKGRFTISRDNSKNTLYLQMNSLRAEDTAVYYCARDRGYTSSWYPDAF*

*DIWGQGTMVTVSS*;

[SEQ ID NO: 259]
(L) MXAMAEVQLLESGGGLVQPGGSLRLSCAASGFTFSSYAMSWVRQAPGKGLEWVSSIT

AEGTHTWYADSVKGRFTISRDNSKNTLYLQMNSLRAEDTAVYYCAKTSYRFDYWGQGTLVTVSSGG

GGSGGGGSGGGGSTDIQMTQSPSSLSASVGDRVTITCRASQSISSYLNWYQQKPGKAPKLLIYKAS

RLQSGVPSRFSGSGSGTDFTLTISSLQPEDFATYYCQQKWDPPRTFGQGTKVEIKRAAAHHHHHHG

AAEQKLISEEDLN[GGGG]<sub>n</sub>*QSVLTQPPSVSGAPGQRVTISCTGSSSNTGAGYDVHWYQQVPGTAP*

*KLLIYGSGNRPSGVPDRFSGSKSGTSASLAITGLQAEDEADYYCQSYDSSLSGWVFGGGTRLTVLG*

GGGSGGGGSGGGGSQVQLVESGGGWQPGRSLRLSCAASGFTFSSYGMHWVRQAPGKGLEWVA

VIWYDGSNEYYADSVKGRFTISRDNSKNTLYLQMNSLRAEDTAVYYCARDRGYTSSWYPDAFDIWG

QGTMVTVSS;

[SEQ ID NO: 260]
(M) MXAMAEVQLLESGGGLVQPGGSLRLSCAASGFTFSSYAMSWVRQAPGKGLEWVSSIT

AEGTHTWYADSVKGRFTISRDNSKNTLYLQMNSLRAEDTAVYYCAKTSYRFDYWGQGTLVTVSSGG

GGSGGGGSGGGGSTDIQMTQSPSSLSASVGDRVTITCRASQSISSYLNWYQQKPGKAPKLLIYKAS

RLQSGVPSRFSGSGSGTDFTLTISSLQPEDFATYYCQQKWDPPRTFGQGTKVEIKRAAAHHHHHHG

AAEQKLISEEDLN[GGGGG]$_n$QSVLTQPPSVSGAPGQRVTISCTGSSSNTGAGYDVHWYQQVPGTA

PKLLIYGSNRPSGVPDRFSGSKSGTSASLAITGLQAEDEADYYCQSYDSSLSGWVFGGGTRLTVLG

GGGSGGGGSGGGGSQVQLVESGGGWQPGRSLRLSCAASGFTFSSYGMHWVRQAPGKGLEWVA

VIWYDGSNEYYADSVKGRFTISRDNSKNTLYLQMNSLRAEDTAVYYCARDRGYTSSWYPDAFDIWG

QGTMVTVSS;

[SEQ ID NO: 261]
(N) MXAMAEVQLLESGGGLVQPGGSLRLSCAASGFTFSSYAMSWVRQAPGKGLEWVSSIT

AEGTHTWYADSVKGRFTISRDNSKNTLYLQMNSLRAEDTAVYYCAKTSYRFDYWGQGTLVTVSSGG

GGSGGGGSGGGGSTDIQMTQSPSSLSASVGDRVTITCRASQSISSYLNWYQQKPGKAPKLLIYKAS

RLQSGVPSRFSGSGSGTDFTLTISSLQPEDFATYYCQQKWDPPRTFGQGTKVEIKRAAAHHHHHHG

AAEQKLISEEDLN[GGGKGGGG]$_n$QSVLTQPPSVSGAPGQRVTISCTGSSSNTGAGYDVHWYQQVP

GTAPKLLIYGSNRPSGVPDRFSGSKSGTSASLAITGLQAEDEADYYCQSYDSSLSGWVFGGGTRLT

VLGGGGSGGGGSGGGGSQVQLVESGGGVVQPGRSLRLSCAASGFTFSSYGMHWVRQAPGKGLE

WVAVIWYDGSNEYYADSVKGRFTISRDNSKNTLYLQMNSLRAEDTAVYYCARDRGYTSSWYPDAF

DIWGQGTMVTVSS;

[SEQ ID NO: 262]
(O) MXAMAEVQLLESGGGLVQPGGSLRLSCAASGFTFSSYAMSWVRQAPGKGLEWVSSIT

AEGTHTWYADSVKGRFTISRDNSKNTLYLQMNSLRAEDTAVYYCAKTSYRFDYWGQGTLVTVSSGG

GGSGGGGSGGGGSTDIQMTQSPSSLSASVGDRVTITCRASQSISSYLNWYQQKPGKAPKLLIYKAS

RLQSGVPSRFSGSGSGTDFTLTISSLQPEDFATYYCQQKWDPPRTFGQGTKVEIKRAAAHHHHHHG

AAEQKLISEEDLN[GGGNGSGG]$_n$QSVLTQPPSVSGAPGQRVTISCTGSSSNTGAGYDVHWYQQVP

GTAPKLLIYGSNRPSGVPDRFSGSKSGTSASLAITGLQAEDEADYYCQSYDSSLSGWVFGGGTRLT

VLGGGGSGGGGSGGGGSQVQLVESGGGVVQPGRSLRLSCAASGFTFSSYGMHWVRQAPGKGLE

WVAVIWYDGSNEYYADSVKGRFTISRDNSKNTLYLQMNSLRAEDTAVYYCARDRGYTSSWYPDAF

DIWGQGTMVTVSS;

[SEQ ID NO: 263]
(P) MXAMAEVQLLESGGGLVQPGGSLRLSCAASGFTFSSYAMSWVRQAPGKGLEWVSSIT

AEGTHTWYADSVKGRFTISRDNSKNTLYLQMNSLRAEDTAVYYCAKTSYRFDYWGQGTLVTVSSGG

GGSGGGGSGGGGSTDIQMTQSPSSLSASVGDRVTITCRASQSISSYLNWYQQKPGKAPKLLIYKAS

RLQSGVPSRFSGSGSGTDFTLTISSLQPEDFATYYCQQKWDPPRTFGQGTKVEIKRAAAHHHHHHG

AAEQKLISEEDLN[GGGCGGGG]$_n$QSVLTQPPSVSGAPGQRVTISCTGSSSNTGAGYDVHWYQQVP

GTAPKLLIYGSNRPSGVPDRFSGSKSGTSASLAITGLQAEDEADYYCQSYDSSLSGWVFGGGTRLT

VLGGGGSGGGGSGGGGSQVQLVESGGGVVQPGRSLRLSCAASGFTFSSYGMHWVRQAPGKGLE

WVAVIWYDGSNEYYADSVKGRFTISRDNSKNTLYLQMNSLRAEDTAVYYCARDRGYTSSWYPDAF

DIWGQGTMVTVSS;

-continued

[SEQ ID NO: 264]
(Q) MXAMAEVQLLESGGGLVQPGGSLRLSCAASGFTFSSYAMSWVRQAPGKGLEWVSSIT

AEGTHTWYADSVKGRFTISRDNSKNTLYLQMNSLRAEDTAVYYCAKTSYRFDYWGQGTLVTVSSGG

GGSGGGGSGGGGSTDIQMTQSPSSLSASVGDRVTITCRASQSISSYLNWYQQKPGKAPKLLIYKAS

RLQSGVPSRFSGSGSGTDFTLTISSLQPEDFATYYCQQKWDPPRTFGQGTKVEIKRAAAHHHHHG

AAEQKLISEEDLN[GPNGG]<sub>n</sub>*QSVLTQPPSVSGAPGQRVTISCTGSSSNTGAGYDVHWYQQVPGTAP*

*KLLIYGSGNRPSGVPDRFSGSKSGTSASLAITGLQAEDEADYYCQSYDSSLSGWVFGGGTRLTVLG*

*GGGSGGGGSGGGGSQVQLVESGGGWQPGRSLRLSCAASGFTFSSYGMHWVRQAPGKGLEWVA*

*VIWYDGSNEYYADSVKGRFTISRDNSKNTLYLQMNSLRAEDTAVYYCARDRGYTSSWYPDAFDIWG*

*QGTMVTVSS*;

[SEQ ID NO: 265]
(R) MXAMAEVQLLESGGGLVQPGGSLRLSCAASGFTFSSYAMSWVRQAPGKGLEWVSSIT

AEGTHTWYADSVKGRFTISRDNSKNTLYLQMNSLRAEDTAVYYCAKTSYRFDYWGQGTLVTVSSGG

GGSGGGGSGGGGSTDIQMTQSPSSLSASVGDRVTITCRASQSISSYLNWYQQKPGKAPKLLIYKAS

RLQSGVPSRFSGSGSGTDFTLTISSLQPEDFATYYCQQKWDPPRTFGQGTKVEIKRAAAHHHHHG

AAEQKLISEEDLN*QSVLTQPPSVSGAPGQRVTISCTGSSSNTGAGYDVHWYQQVPGTAPKLLIYGSG*

*NRPSGVPDRFSGSKSGTSASLAITGLQAEDEADYYCQSYDSSLSGWVFGGGTRLTVLGGGGSGGG*

*GSGGGGSQVQLVESGGGVVQPGRSLRLSCAASGFTFSSYGMHWVRQAPGKGLEWVAVIWYDGSN*

*EYYADSVKGRFTISRDNSKNTLYLQMNSLRAEDTAVYYCARDRGYTSSWYPDAFDIWGQGTMVTVS*

*S*;
wherein:

[SEQ ID NO: 57]
AMAEVQLLESGGGLVQPGGSLRLSCAASGFTFSSYAMSWVRQAPGKGLEWVSSITAEGTH

TWYADSVKGRFTISRDNSKNTLYLQMNSLRAEDTAVYYCAKTSYRFDYWGQGTLVTVSSGGGGSG

GGGSGGGGSTDIQMTQSPSSLSASVGDRVTITCRASQSISSYLNWYQQKPGKAPKLLIYKASRLQS

GVPSRFSGSGSGTDFTLTISSLQPEDFATYYCQQKWDPPRTFGQGTKVEIKRAAAHHHHHHGAAEQ

KLISEEDLN = β-cell specific scFv

Underlined Text is Flexible Linker;
Text in italics is anti-IL23 scFv;
n=1 or more, suitably 1, 2, 3, 4, 5, 6, 7, 8, 9 or 10; and
X is an optional tag (e.g., FLAGS His6) for purification.

In still other embodiments, the CHEF: stress inhibitor s an antigen-binding molecule that is immuno-interactive with IL-23R and the targeting agent is an antigen-binding molecule that is immuno-interactive with a β-cell surface binding protein as taught for example in WO 2010/096930. Non-limiting examples of constructs of this type include:

[SEQ ID NO: 266]
(a) MXDIQMTQSPSSLSASVGDRVTITCLASEDIYNNLAWYQQKPGKAPKLLIYHASSLQD

*GVPSRFSGSGSGTDFTLTISSLQPEDFATYYCLQDSEYPPTFGQGTKVEIKRGGGGSGGGGSGGGG*

*SQVQLVESGGGVVQPGRSLRLSCAASGFDFNSYGMSWVRQAPGKGLEWVADINSKSYNYATYYAD*

*SVKDRFTISRDNSKNTLYLQMNSLRAEDTAVYYCARHHSDYFEYWGQGTLVTVSS*[GGGGSGGGG

SGGGGSGGGGS]<sub>n</sub>AMAEVQLLESGGGLVQPGGSLRLSCAASGFTFSSYAMSWVRQAPGKGLEWVS

SITAEGTHTWYADSVKGRFTISRDNSKNTLYLQMNSLRAEDTAVYYCAKTSYRFDYWGQGTLVTVS

SGGGGSGGGGSGGGGSTDIQMTQSPSSLSASVGDRVTITCRASQSISSYLNWYQQKPGKAPKLLI

-continued

YKASRLQSGVPSRFSGSGSGTDFTLTISSLQPEDFATYYGQQKWDPPRTFGQGTKVEIKRAAAHHH
HHHGAAEQKLISEEDLN;

[SEQ ID NO: 267]
(b) MXDIQMTQSPSSLSASVGDRVTITCLASEDIYNNLAWYQQKPGKAPKLLIYHASSLQD
GVPSRFSGSGSGTDFTLTISSLQPEDFATYYCLQBSEYPPTFGQGTKVEIKRGGGGSGGGGSGGGG
SQVQLVESGGGVVQPGRSLRLSCAASGFDFNSYGMSWVRQAPGKGLEWVADINSKSYNYATYYAD
SVKDRFTISRDNSKNTLYLQMNSLRAEDTAVYYCARHHSDYFEYWGQGTLVTVSS[GGGSGGGS]ₙ
AMAEVQLLESGGGLVQPGGSLRLSCAASGFTFSSYAMSWVRQAPGKGLEWVSSITAEGTHTWYAD
SVKGRFTISRDNSKNTLYLQMNSLRAEDTAVYYGAKTSYRFDYWGQGTLVTVSSGGGGSGGGGSG
GGGSTDIQMTQSPSSLSASVGDRVTITCRASQSISSYLNWYQQKPGKAPKLLIYKASRLQSGVPSRF
SGSGSGTDFTLTISSLQPEDFATYYCQQKWDPPRTFGQGTKVEIKRAAAHHHHHHGAAEQKLISEE
DLN;

[SEQ ID NO: 268]
(c) MXDIQMTQSPSSLSASVGDRVTITCLASEDIYNNLAWYQQKPGKAPKLLIYHASSLQDG
VPSRFSGSGSGTDFTLTISSLQPEDFATYYCLQDSEYPPTFGQGTKVEIKRGGGGSGGGGSGGGGS
QVQLVESGGGVVQPGRSLRLSCAASGFDFNSYGMSWVRQAPGKGLEWVADINSKSYNYATYYADS
VKDRFTISRDNSKNTLYLQMNSLRAEDTAVYYCARHHSDYFEYWGQGTLVTVSS[GGGG]ₙAMAEV
QLLESGGGLVQPGGSLRLSCAASGFTFSSYAMSWVRQAPGKGLEWVSSITAEGTHTWYADSVKGR
FTISRDNSKNTLYLQMNSLRAEDTAVYYCAKTSYRFDYWGQGTLVTVSSGGGGSGGGGSGGGGST
DIQMTQSPSSLSASVGDRVTITCRASQSISSYLNWYQQKPGKAPKLLIYKASRLQSGVPSRFSGSGS
GTDFTLTISSLQPEOFATYYCQQKWDPPRTFGQGTKVEIKRAAAHHHHHHGAAEQKLISEEDLN;

[SEQ ID NO: 269]
(d) MXDIQMTQSPSSLSASVGDRVTITCLASEDIYNNLAWYQQKPGKAPKLLIYHASSLQD
GVPSRFSGSGSGTDFTLTISSLQPEDFATYYCLQDSEYPPTFGQGTKVEIKRGGGGSGGGGSGGGG
SQVQLVESGGGVVQPGRSLRLSCAASGFDFNSYGMSWVRQAPGKGLEWVADINSKSYNYATYYAD
SVKDRFTISRDNSKNTLYLQMNSLRAEDTAVYYCARHHSDYFEYWGQGTLVTVSS[GGGGG]ₙAMA
EVQLLESGGGLVQPGGSLRLSCAASGFTFSSYAMSWVRQAPGKGLE1WSSITAEGTHTWYADSVK
GRFTISRDNSKNTLYLQMNSLRAEDTAVYYCAKTSYRFDYWGQGTLVTVSSGGGGSGGGGSGGGG
STDIQMTQSPSSLSASVGDRVTITCRASQSISSYLNWYQQKPGKAPKLLIYKASRLQSGVPSRFSGS
GSGTDFTLTISSLQPEDFATYYCQQKWDPPRTFGQGTKVEIKRAAAHHHHHHGAAEQKLISEEDLN;

[SEQ ID NO: 270]
(e) MXDIQMTQSPSSLSASVGDRVTITCLASEDIYNNLAWYQQKPGKAPKLLIYHASSLQD
GVPSRFSGSGSGTDFTLTISSLQPEDFATYYCLQDSEYPPTFGQGTKVEIKRGGGGSGGGGSGGGG
SQVQLVESGGGVVQPGRSLRLSCAASGFDFNSYGMSWVRQAPGKGLEWVADINSKSYNYATYYAD
SVKDRFTISRDNSKNTLYLQMNSLRAEDTAVYYCARHHSDYFEYWGQGTLVTVSS[GGGKGGGG]ₙ
AMAEVQLLESGGGLVQPGGSLRLSCAASGFTFSSYAMSWVRQAPGKGLEWVSSITAEGTHTWYAD
SVKGRFTISRDNSKNTLYLQMNSLRAEDTAVYYCAKTSYRFDYWGQGTLVTVSSGGGGSGGGGSG
GGGSTDIQMTQSPSSLSASVGDRVTITCRASQSISSYLNWYQQKPGKAPKLLIYKASRLQSGVPSRF
SGSGSGTDFTLTISSLQPEDFATYYCQQKWDPPRTFGQGTKVEIKRAAAHHHHHHGAAEQKLISEE
DLN;

[SEQ ID NO: 271]
(f) MXDIQMTQSPSSLSASVGDRVTITCLASEDIYNNLAWYQQKPGKAPKLLIYHASSLQDG
VPSRFSGSGSGTDFTLTISSLQPEDFATYYCLQDSEYPPTFGQGTKVEIKRGGGGSGGGGSGGGGS

-continued

QVQLVESGGGVVQPGRSLRLSCAASGFDFNSYGMSWVRQAPGKGLEWVADINSKSYNYATYYADS
VKDRFTISRDNSKNTLYLQMNSLRAEDTAVYYCARHHSDYFEYWGQGTLVTVSS[GGGNGSGG]<sub>n</sub>A
MAEVQLLESGGGLVQPGGSLRLSCAASGFTFSSYAMSWVRQAPGKGLEWVSSITAEGTHTWYADS
VKGRFTISRDNSKNTLYLQMNSLRAEDTAVYYCAKTSYRFDYWGQGTLVTVSSGGGGSGGGGSGG
GGSTDIQMTQSPSSLSASVGDRVTITCRASQSISSYLNWYQQKPGKAPKLLIYKASRLQSGVPSRFS
GSGSGTDFTLTISSLQPEDFATYYCQQKWDPPRTFGQGTKVEIKRAAAHHHHHHGAAEQKLISEEDL
N;

[SEQ ID NO: 272]
(g) MXDIQMTQSPSSLSASVGDRVTITCLASEDIYNNLAWYQQKPGKAPKLLIYHASSLQD
GVPSRFSGSGSGTDFTLTISSLQPEDFATYYCLQDSEYPPTFGQGTKVEIKRGGGGSGGGGSGGGG
SQVQLVESGGGVVQPGRSLRLSCAASGFDFNSYGMSWVRQAPGKGLEWVADINSKSYNYATYYAD
SVKDRFTISRDNSKNTLYLQMNSLRAEDTAVYYCARHHSDYFEYWGQGTLVTVSS[GGGCGGGG]<sub>n</sub>
AMAEVQLLESGGGLVQPGGSLRLSCAASGFTFSSYAMSWVRQAPGKGLEWVSSITAEGTHTWYAD
SVKGRFTISRDNSKNTLYLQMNSLRAEDTAVYYCAKTSYRFDYWGQGTLVTVSSGGGGSGGGGSG
GGGSTDIQMTQSPSSLSASVGDRVTITCRASQSISSYLNWYQQKPGKAPKLLIYKASRLQSGVPSRF
SGSGSGTDFTLTISSLQPEDFATYYCQQKWDPPRTFGQGTKVESKRAAAHHHHHHGAAEQKLISEE
DLN;

[SEQ ID NO: 273]
(h) MXDIQMTQSPSSLSASVGDRVTITCLASEDIYNNLAWYQQKPGKAPKLLIYHASSLQD
GVPSRFSGSGSGTDFTLTISSLQPEDFATYYCLQDSEYPPTFGQGTKVEIKRGGGGSGGGGSGGGG
SQVQLVESGGGVVQPGRSLRLSCAASGFDFNSYGMSWVRQAPGKGLEWVADINSKSYNYATYYAD
SVKDRFTISRDNSKNTLYLQMNSLRAEDTAVYYCARHHSDYFEYWGQGTLVTVSS[GPNGG]<sub>n</sub>AMAE
VQLLESGGGLVQPGGSLRLSCAASGFTFSSYAMSWVRQAPGKGLEWVSSITAEGTHTWYADSVKG
RFTISRDNSKNTLYLQHNSLRAEDTAVYYCAKTSYRFDYWGQGTLVTVSSGGGGSGGGGSGGGGS
TDIQMTQSPSSLSASVGDRVTITCRASQSISSYLNWYQQKPGKAPKLLIYKASRLQSGVPSRFSGSG
SGTDFTLTISSLQPEDFATYYGQQKWDPPRTFGQGTKVEIKRAAAHHHHHHGAAEQKLISEEDLN;

[SEQ ID NO: 274]
(i) MXDIQMTQSPSSLSASVGDRVTITCLASEDIYNNLAWYQQKPGKAPKLLIYHASSLQDG
VPSRFSGSGSGTDFTLTISSLQPEDFATYYCLQDSEYPPTFGQGTKVEIKRGGGGSGGGGSGGGGS
QVQLVESGGGVVQPGRSLRLSCAASGFDFNSYGMSWVRQAPGKGLEWVADINSKSYNYATYYADS
VKDRFTISRDNSKNTLYLQMNSLRAEPTAVYYCARHHSDYFEYWGQGTLVTVSSAMAEVQLLESGG
GLVQPGGSLRLSCAASGFTFSSYAMSWVRQAPGKGLEWVSSITAEGTHTWYADSVKGRFTISRDN
SKNTLYLQMNSLRAEDTAVYYCAKTSYRFDYWGQGTLVTVSSGGGGSGGGGSGGGGSTDIQMTQ
SPSSLSASVGDRVTITCRASQSISSYLNWYQQKPGKAPKLLIYKASRLQSGVPSRFSGSGSGTDFTL
TISSLQPEDFATYYCQQKWDPPRTFGQGTKVEIKRAAAHHHHHHGAAEQKLISEEDLN
wherein:

[SEQ ID NO: 57]
AMAEVQLLESGGGLVQPGGSLRLSCAASGFTFSSYAMSWVRQAPGKGLEWVSSITAEGTH
TWYADSVKGRFTISRDNSKNTLYLQMNSLRAEDTAVYYCAKTSYRFDYWGQGTLVTVSSGGGGSG

GGGSGGGGSTDIQMTQSPSSLSASVGDRVTITCRASQSISSYLNWYQQKPGKAPKLLIYKASRLQS

GVPSRFSGSGSGTDFTLTISSLQPEDFATYYCQQKWDPPRTFGQGTKVEIKRAAAHHHHHHGAABQ

KLISEEDLN = β-cell specific scFv

Underlined Text is Flexible Linker;
Text in italics is anti-IL23R scFv;
n=1 or more, suitably 1, 2, 3, 4, 5, 6, 7, 8, 9 or 10; and
X is an optional tag (e.g., FLAGS, His6) for purification,
or

[SEQ ID NO: 275]
(j) MXAMAEVQLLESGGGLVQPGGSLRLSCAASGFTFSSYAMSWVRQAP
GKGLEWVSSITAEGTHTWYADSVKGRFTISRDNSKNTLYLQMNSLRAED
TAVYYCAKTSYRFDYWGQGTLVTVSSGGGGSGGGGSGGGGSTDIQMTQSP
SSLSASVGDRVTITCRASQSISSYLNWYQQKPGKAPKLLIYKASRLQSGV
PSRFSGSGSGTDFTLTISSLQPEDFATYYCQQKWDPPRTFGQGTKVEIKR
AAAHHHHHHGAAEQKLISEEDLN[GGGGSGGGGSGGGGSGGGGS]*<sub>n</sub>*DIQMT
*QSPSSLSASVGDRVTITCLASEDIYNNLAWYQQKPGKAPKLLIYHASSLQ*
*DGVPSRFSGSGSGTDFTLTISSLQPEDFATYYCLQDSEYPPTFGQGTKVE*
*IKRGGGGSGGGGSGGGGSQVQLVESGGGVVQPGRSLRLSCAASGFDFNSY*
*GMSWVRQAPGKGLEWVADINSKSYNYATYYADSVKDRFTISRDNSKNTLY*
*LQMNSLRAEDTAVYYCARHHSDYFEYWGQGTLVTVSS*;

[SEQ ID NO: 276]
(k) MXAMAEVQLLESGGGLVQPGGSLRLSCAASGFTFSSYAMSWVRQAP
GKGLEWVSSITAEGTHTWYADSVKGRFTISRDNSKNTLYLQMNSLRAEDT
AVYYCAKTSYRFDYWGQGTLVTVSSGGGGSGGGGSGGGGSTDIQMTQSPS
SLSASVGDRVTITCRASQSISSYLNWYQQKPGKAPKLLIYKASRLQSGVP
SRFSGSGSGTDFTLTISSLQPEDFATYYCQQKWDPPRTFGQGTKVEIKRA
AAHHHKHHGAAEQKLISEEDLN[GGGSGGGS]*<sub>n</sub>DIQMTQSPSSLSASVGDR*
*VTITCLASEDIYNNLAWYQQKPGKAPKLLIYHASSLQDGVPSRFSGSGSG*
*TDFTLTISSLQPEDFATYYCLQDSEYPPTFGQGTKVEIKRGGGGSGGGGS*
*GGGGSQVQLVESGGGVVQPGRSLRLSCAASGFDFNSYGMSWVRQAPGKGL*
*EWVADINSKSYNYATYYADSVKDRFTISRDNSKNTLYLQMNSLRAEDTAV*
*YYCARHHSDYFEYWGQGTLVTVSS*;

[SEQ ID NO: 277]
(l) MXAMAEVQLLESGGGLVQPGGSLRLSGAASGFTFSSYAMSWVRQAP
GKGLEWVSSITAEGTHTWYADSVKGRFTISRDNSKNTLYLQMNSLRAEDT
AVYYCAKTSYRFDYWGQGTLVTVSSGGGGSGGGGSGGGGSTDIQMTQSPS
SLSASVGDRVTITCRASQSISSYLNWYQQKPGKAPKLLIYKASRLQSGVP
SRFSGSGSGTDFTLTISSLQPEDFATYYCQQKWDPPRTFGQGTKVEIKRA
AAHHHHHHGAAEQKLISEEDLN[GGGG]*<sub>n</sub>DIQMTQSPSSLSASVGDRVTIT*
*CLASEDIYNNLAWYQQKPGKAPKLLIYHASSLQDGVPSRFSGSGSGTDFT*
*LTISSLQPEDFATYYCLQDSEYPPTFGQGTKVEIKRGGGGSGGGGSGGGS*
*SQVQLVESGGGVVQPGRSLRLSCAASGFDFNSYGMSWVRQAPGKGLEWVA*
*DINSKSYNYATYYADSVKDRFTISRDNSKNTLYLQMNSLRAEDTAVYYCA*
*RHHSDYFEYWGQGTLVTVSS*;

[SEQ ID NO: 278]
(m) MXAMAEVQLLESGGGLVQPGGSLRLSCAASGFTFSSYAMSWVRQAP
GKGLEWVSSITAEGTHTWYADSVKGRFTISRDNSKNTLYLQMNSLRAEDT
AVYYCAKTSYRFDYWGQGTLVTVSSGGGGSGGGGSGGGGSTDIQMTQSPS
SLSASVGDRVTITCRASQSISSYLNWYQQKPGKAPKLLIYKASRLQSGVP
SRFSGSGSGTDFTLTISSLQPEDFATYYCQQKWDPPRTFGQGTKVEIKRA
AAHHHHHHGAAEQKLISEEDLN[GGGGG]*<sub>n</sub>DIQMTQSPSSLSASVGDRVTI*
*TCLASEDIYNNLAWYQQKPGKAPKLLIYHASSLQDGVPSRFSGSGSGTDF*
*TLTISSLQPEDFATYYCLQDSEYPPTFGQGTKVEIKRGGGGSGGGGSGGG*
*GSQVQLVESGGGVVQPGRSLRLSCAASGFDFNSYGMSWVRQAPGKGLEWV*
*ADINSKSYNYATYYADSVKDRFTISRDNSKNTLYLQMNSLRAEDTAVYYC*
*ARHHSDYFEYWGQGTLVTVSS*;

[SEQ ID NO: 279]
(n) MXAMAEVQLLESGGGLVQPGGSLRLSCAASGFTFSSYAMSWVRQAP
GKGLEWVSSITAEGTHTWYADSVKGRFTISRDNSKNTLYLQMNSLRAEDT
AVYYCAKTSYRFDYWGQGTLVTVSSGGGGSGGGGSGGGGSTDIQMTQSPS
SLSASVGDRVTITCRASQSISSYLNWYQQKPGKAPKLLIYKASRLQSGVP
SRFSGSGSGTDFTLTISSLQPEDFATYYCQQKWDPPRTFGQGTKVEIKRA
AAHHHHHHGAAEQKLISEEDLN[GGGKGGGG]*<sub>n</sub>DIQMTQSPSSLSASVGDR*
*VTITCLASEDIYNNLAWYQQKPGKAPKLLIYHASSLQDGVPSRFSGSGSG*
*TDFTLTISSLQPEDFATYYCLQDSEYPPTFGQGTKVEIKRGGGGSGGGGS*
*GGGGSQVQLVESGGGVVQPGRSLRLSCAASGFDFNSYGMSWVRQAPGKGL*
*EWVADINSKSYNYATYYADSVKDRFTISRDNSKNTLYLQMNSLRAEDTAV*
*YYCARHHSDYFEYWGQGTLVTVSS*;

[SEQ ID NO: 280]
(o) MXAMAEVQLLESGGGLVQPGGSLRLSCAASGFTFSSYAMSWVRQAP
GKGLEWVSSITAEGTHTWYADSVKGRFTISRDNSKNTLYLQMNSLRAEDT
AVYYCAKTSYRFDYWGQGTLVTVSSGGGGSGGGGSGGGGSTDIQMTQSPS
SLSASVGDRVTITCRASQSISSYLNWYQQKPGKAPKLLIYKASRLQSGVP
SRFSGSGSGTDFTLTISSLQPEDFATYYCQQKWDPPRTFGQGTKVEIKRA
AAHHHHHHGAAEQKLISEEDLN[GGGNSGG]*<sub>n</sub>DIQMTQSPSSLSASVGDRV*
*TITCLASEDIYNNLAWYQQKPGKAPKLLIYHASSLQDGVPSRFSGSGSGT*
*DFTLTISSLQPEDFATYYCLQDSEYPPTFGQGTKVEIKRGGGGSGGGGSG*
*GGGSQVQLVESGGGVVQPGRSLRLSCAASGFDFNSYGMSWVRQAPGKGLE*
*WVADINSKSYNYATYYADSVKDRFTISRDNSKNTLYLQMNSLRAEDTAVY*
*YCARHHSDYFEYWGQGTLVTVSS*;

-continued

[SEQ ID NO: 281]
(p) MXAMAEVQLLESGGGLVQPGGSLRLSCAASGFTFSSYAMSWVRQAP
GKGLEWVSSITAEGTHTWYADSVKGRFTISRDNSKNTLYLQMNSLRAEDT
AVYYCAKTSYRFDYWGQGTLVTVSSGGGGSGGGGSGGGGSTDIQMTQSPS
SLSASVGDRVTITCRASQSISSYLNWYQQKPGKAPKLLIYKASRLQSGVP
SRFSGSGSGTDFTLTISSLQPEDFATYYCQQKWDPPRTFGQGTKVEIKRA
AAHHHHHHGAAEQKLISEEDLN[GGGCGGGG]<sub>n</sub>*DIQMTQSPSSLSASVGDR*
*VTITCLASEDIYNNLAWYQQKPGKAPKLLIYHASSLQDGVPSRFSGSGSG*
*TDFTLTISSLQPEDFATYYCLQDSEYPPTFGQGTVEIKRGGGGSGGGGSG*
*GGGSQVQLVESGGGVVQPGRSLRLSCAASGFDFNSYGMSWVRQAPGKGLE*
*WVADINSKSYNYATYYADSVKDRFTISRDNSKNTLYLQMNSLRAEDTAVY*
*YCARHHSDYFEYQGQGTLVTVSS*;

[SEQ ID NO: 282]
(q) MXAMAEVQLLESGGGLVQPGGSLRLSCAASGFTFSSYAMSWVRQAP
GKGLEWVSSITAEGTHTWYADSVKGRFTISRDNSKNTLYLQMNSLRAEDT
AVYYCAKTSYRFDYWGQGTLVTVSSGGGGSGGGGSGGGGSTDIQMTQSPS
SLSASVGDRVTITCRASQSISSYLNWYQQKPGKAPKLLIYKASRLQSGVP
SRFSGSGSGTDFTLTISSLQPEDFATYYCQQKWDPPRTFGQGTKVEIKRA
AAHHHHHHGAAEQKLISEEDLN[GPNGG]<sub>n</sub>*DIQMTQSPSSLSASVGDRVTI*
*TCLASEDIYNNLAWYQQKPGKAPKLLIYHASSLQDGVPSRFSGSGSGTDF*
*TLTISSLQPEDFATYYCLQDSEYPPTFGQGJKVEIKRGGGGSGGGGSGGG*
*GSQVQLVESGGGVVQPGRSLRLSCAASGFDFNSYGMSWVRQAPGKGLEWV*
*ADINSKSYNYATYYADSVKDRFTISRDNSKNTLYLQMNSLRAEDTAVYYC*
*ARHHSDYFEYWGQGTLVTVSS*;

[SEQ ID NO: 283]
(r) MXAMAEVQLLESGGGLVQPGGSLRLSCAASGFTFSSYAMSWVRQAP
GKGLEWVSSITAEGTHTWYADSVKGRFTISRDNSKNTLYLQMNSLRAEDT
AVYYCAKTSYRFDYWGQGTLVTVSSGGGGSGGGGSGGGGSTDIQMTQSPS
SLSASVGDRVTITCRASQSISSYLNWYQQKPGKAPKLLIYKASRLQSGVP
SRFSGSGSGTDFTLTISSLQPEDFATYYCQQKWDPPRTFGQGTKVEIKRA
AAHHHHHHGAAEQKLISEEDLN*DIQMTQSPSSLSASVGDRVTITCLASED*
*IYNNLAWYQQKPGKAPKLLIYHASSLQDGVPSRFSGSGSGTDFTLTISSL*
*QPEDFATYYCLQDSEYPPTFGQGTKVEIKRGGGGSGGGGSGGGGSQVQLV*
*ESGGGVVQPGRSLRLSCAASGFDFNSYGMSWVRQAPGKGLEWVADINSKS*
*YNYATYYADSVKDRFTISRDNSKNTLYLQMNSLRAEDTAVYYCARHHSDY*
*FEYWGQGTLVTVSS*;
wherein:

[SEQ ID NO: 57]
AMAEVQLLESGGGLVQPGGSLRLSCAASGFTFSSYAMSWVRQAPGKGLEW
VSSITAEGTHTWYADSVKGRFTISRDNSKNTLYLQMNSLRAEDTAVYYCA
KTSYRFDYWGQGTLVTVSSGGGGSGGGGSGGGGSTDIQMTQSPSSLSASV
GDRVTITCRASQSISSYLNWYQQKPGKAPKLLIYKASRLQSGVPSRFSGS
GSGTDFTLTISSLQPEDFATYYCQQKWDPPRTFGQGTKVEIKRAAAHHHH
HHGAAEQKLISEEDLN = β-cell specific scFv Underlined Text is Flexible Linker;
Text in italics is anti-IL23R scFv;
n=1 or more, suitably 1, 2, 3, 4, 5, 6, 7, 8, 9 or 10; and
X is an optional tag (e.g., FLAGS, His6) for purification.

In other embodiments of the anti-IL-24 and IL-23 constructs defined above, the chimeric constructs comprise alternative β=cell specific scFv substituted for the scFv defined above, illustrative examples of which include:

[SEQ ID NO: 58]
AMAEVQLLESGGGLVQPGGSLRLSCAASGFTFSSYAMSWVRQAPGKGLEW
VSRIKIFGSKTKFADSVKGRFTISRDNSKNTLYLQMNSLRAEDTAVYYCA
KHSTHFDYWGQGTLVTVSSGGGGSGGGGSGGGGSTDIQMTQSPSSLSASV
GDRVTITCRASQSISSYLNWYQQKPGKAPKLLIYRASSLQSGVPSRFSGS
GSGTDFTLTISSLQPEDFATYYCQQLQSTPRTFGQGTKVEIKRAAAHHHH
HHGAAEQKLISEEDLN;

[SEQ ID NO: 59]
AMAEVQLLESGGGLVQPGGSLRLSCAASGFTFSSYAMSWVRQAPGKGLEW
VSSIHPKGYPTRYADSVKGRFTISRDNSKNTLYLQMNSLRAEDTAVYYCA
KSTTPFDYWGQGTLVTVSSGGGGSGGGGSGGGGSTDIQMTQSPSSLSASV
GDRVTITCRASQSISSYLNWYQQKPGKAPKLLIYAASSLQSGVPSRFSGS
GSGTDFTLTISSLQPEDFATYYCQQMGRDPRTFGQGTKVEIKRAAAHHHH
HHGAAEQKLISEEDLN;

[SEQ ID NO: 60]
AMAEVQLLESGGGLVQPGGSLRLSCAASGFTFSSYAMSWVRQAPGKGLEW
VSRIQFFGSHTYFADSVKGRFTISRDNSKNTLYLQMNSLRAEDTAVYYCA
KHSTHFDYWGQGTLVTVSSGGGGSGGGGSGGGGSTDIMTQSPSSLSASVG
DRVTITCRASQSISSYLNWYQQKPGKAPKLLIYRASILQSGVPSRFSGSG
SGTDFTLTISSLQPEDFATYYCQQNRRIPRTFGQGTKVEIKRAAAHHHHH
HGAAEQKLISEEDLN;
and

[SEQ ID NO: 61]
AMAEVQLLESGGGLVQPGGSLRLSCAASGFTFSSYAMSWVRQAPGKGLEW
VSSISSTGDSTSYADSVKGRFTISRDNSKNTLYLQMNSLRAEDTAVYYCA
KAADSFDYWGQGTLVTVSSGGGGSGGGGSGGGGSTDIQMTQSPSSLSASV
GDRVTITCRASQSISSYLNWYQQKPGKAPKLLIYGASSLQSGVPSRFSGS
GSGTDFTLTISSLQPEDFATYYCQQTNGAPTTFGQGTKVEIKRAAAHHHH
HHGAAEQKLISEEDLN.

6. Delivery Vehicle Embodiments

The present invention contemplates the use of delivery vehicles for targeted delivery of an OER stress inhibitor to a β-cell. The delivery vehicle will generally comprise a β-cell targeting agent and an OER stress inhibitor.

In some embodiments, the delivery vehicle is a polymeric particle. Polymeric particles may be formed from any biocompatible and desirably biodegradable polymer, copolymer, or blend. The polymers may be tailored to optimize different characteristics of the particle including i) interactions between the bioactive agents (i.e., β-cell targeting agent and OER stress inhibitor) and target proteins or receptors on the β-cell and the polymer to provide stabilization of the bioactive agents and retention of activity upon delivery; ii) surface characteristics and targeting capabilities via chemical modification; and iii) particle porosity.

Surface eroding polymers such as polyanhydrides may be used to form the particles. For example, polyanhydrides such as poly[(p-carboxyphenoxy)-hexane anhydride] (PCPH) may be used. Biodegradable polyanhydrides are described in U.S. Pat. No. 4,857,311.

In other embodiments, bulk eroding polymers such as those based on polyesters including poly(hydroxy acids) or poly(esters) can be used. For example, polyglycolic acid (PGA), polylactic acid (PLA), or copolymers thereof may be used to form the particles. The polyester may also have a charged or functionalizable group, such as an amino acid. In illustrative examples, particles with controlled release properties can be formed of poly(D,L-lactic acid) and/or poly (D,L-lactic-co-glycolic acid) ("PLGA").

Other polymers include poly(alkylcyanoacrylates), polyamides, polycarbonates, polyalkylenes such as polyethylene, polypropylene, poly(ethylene glycol), poly(ethylene oxide), poly(ethylene terephthalate), poly vinyl compounds such as polyvinyl alcohols, polyvinyl ethers, and polyvinyl esters, polymers of acrylic and methacrylic acids, celluloses and other polysaccharides, and peptides or proteins, or copolymers or blends thereof. Polymers may be selected with or modified to have the appropriate stability and degradation rates in vivo for different controlled drug delivery applications.

In some embodiments, particles are formed from functionalized polymers such as polyester graft copolymers, as described in Hrkach et al. (1995, Macromolecules, 28:4736-4739; and "Poly(L-Lactic acid-co-amino acid) Graft Copolymers: A Class of Functional Biodegradable Biomaterials" in Hydrogels and Biodegradable Polymers for Bioapplications, ACS Symposium Series No. 627, Raphael M. Ottenbrite et al., Eds., American Chemical Society, Chapter 8, pp. 93-101, 1996.)

Materials other than biodegradable polymers may be used to form the particles. Suitable materials include various non-biodegradable polymers and various excipients. The particles also may be formed of the bioactive agent(s) and surfactant alone.

Polymeric particles may be prepared using single and double emulsion solvent evaporation, spray drying, solvent extraction, solvent evaporation, phase separation, simple and complex coacervation, interfacial polymerization, and other methods well known to those of ordinary skill in the art. Particles may be made using methods for making microspheres or microcapsules known in the art, provided that the conditions are optimized for forming particles with the desired diameter.

Methods developed for making microspheres for delivery of bioactive agents are described in the literature, for example, as described in Doubrow, M., Ed., "Microcapsules and Nanoparticles in Medicine and Pharmacy," CRC Press, Boca Raton, 1992. Methods also are described in Mathiowitz and Langer (1987, J. Controlled Release 5, 13-22); Mathiowitz et al. (1987, Reactive Polymers 6, 275-283); and Mathiowitz et al. (1988, J. Appl. Polymer Sci. 35, 755-774) as well as in U.S. Pat. Nos. 5,213,812, 5,417,986, 5,360,610, and 5,384,133. The selection of the method depends on the polymer selection, the size, external morphology, and crystallinity that is desired, as described, for example, by Mathiowitz et al. (1990, Scanning Microscopy 4: 329-340; 1992, J. Appl. Polymer Sci. 45, 125-134); and Benita et al. (1984, J. Pharm. Sci. 73, 1721-1724).

In solvent evaporation, described for example, in Mathiowitz et al., (1990), Benita; and U.S. Pat. No. 4,272,398 to Jaffe, the polymer is dissolved in a volatile organic solvent, such as methylene chloride. Several different polymer concentrations can be used, for example, between 0.005 and 2.0 g/mL. The bioactive agent(s), either in soluble form or dispersed as fine particles, is (are) added to the polymer solution, and the mixture is suspended in an aqueous phase that contains a surface-active agent such as poly(vinyl alcohol). The aqueous phase may be, for example, a concentration of 1% poly(vinyl alcohol) w/v in distilled water. The resulting emulsion is stirred until most of the organic solvent evaporates, leaving solid microspheres, which may be washed with water and dried overnight in a lyophilizer. Microspheres with different sizes (between 0.1 and 1000 μm) and morphologies can be obtained by this method.

Solvent removal was primarily designed for use with less stable polymers, such as the polyanhydrides. In this method, the agent is dispersed or dissolved in a solution of a selected polymer in a volatile organic solvent like methylene chloride. The mixture is then suspended in oil, such as silicon oil, by stirring, to form an emulsion. Within 24 hours, the solvent diffuses into the oil phase and the emulsion droplets harden into solid polymer microspheres. Unlike the hot-melt microencapsulation method described for example in Mathiowitz et al. (1987, Reactive Polymers, 6:275), this method can be used to make microspheres from polymers with high melting points and a wide range of molecular weights. Microspheres having a diameter for example between one and 300 microns can be obtained with this procedure.

With some polymeric systems, polymeric particles prepared using a single or double emulsion technique, vary in size depending on the size of the droplets. If droplets in water-in-oil emulsions are not of a suitably small size to form particles with the desired size range, smaller droplets can be prepared, for example, by sonication or homogenation of the emulsion, or by the addition of surfactants.

If the particles prepared by any of the above methods have a size range outside of the desired range, particles can be sized, for example, using a sieve, and optionally further separated according to density using techniques known to those of skill in the art.

The polymeric particles can be prepared by spray drying. Methods of spray drying, such as that disclosed in PCT WO 96/09814 by Sutton and Johnson, disclose the preparation of smooth, spherical microparticles of a water-soluble material with at least 90% of the particles possessing a mean size between 1 and 10 μm.

In some embodiments, the particles are liposomes. Liposomes can be produced by standard methods such as those reported by Kim et al. (1983, Biochim. Biophys. Acta 728, 339-348); Liu et al. (1992, Biochim. Biophys. Acta 1104, 95-101); Lee et al. (1992, Biochim. Biophys. Acta. 1103, 185-197), Brey et al. (U.S. Pat. Appl. Pub. 20020041861), Hass et al. (U.S. Pat. Appl. Pub. 20050232984), Kisak et al. (U.S. Pat. Appl. Pub. 20050260260) and Smyth-Templeton et al. (U.S. Pat. Appl. Pub. 20060204566). Additionally, reference may be made to Copeland et al. (2005, Immunol. Cell Biol. 83: 95-105) who review lipid based particulate formulations for the delivery of antigen, and to Bramwell et al. (2005, Crit Rev Ther Drug Carrier Syst. 22(2):151-214;

2006, J Pharm Pharmacol. 58(6):717-728) who review particulate delivery systems for vaccines, including methods for the preparation of protein-loaded liposomes. Many liposome formulations using a variety of different lipid components have been used in various in vitro cell culture and animal experiments. Parameters have been identified that determine liposomal properties and are reported in the literature, for example, by Lee et al. (1992, Biochim. Biophys. Acta. 1103, 185-197); Liu et al. (1992, Biochim. Biophys. Acta, 1104, 95-101); and Wang et al. (1989, Biochem. 28, 9508-951).

In some embodiments, preparative methods based on hydration of dried-lipid film are used, in which the lipids of choice (and any organic-soluble bioactive), dissolved in an organic solvent, are mixed and dried onto the bottom of a glass container under vacuum. The lipid film is rehydrated using an aqueous buffered solution containing any water-soluble bioactives to be encapsulated by gentle swirling. The hydrated lipid vesicles can then be further processed by extrusion, submitted to a series of freeze-thawing cycles or dehydrated and then rehydrated to promote encapsulation of bioactives. Liposomes can then be washed by centrifugation or loaded onto a size-exclusion column to remove unentrapped bioactive from the liposome formulation and stored at 4° C. The basic method for liposome preparation is described in more detail in Thierry et al. (1992, Nuc. Acids Res. 20:5691-5698).

In other embodiments, the delivery agent is a cyclodextrin. Cyclodextrins are cyclic oligosaccharides, which have a central hydrophobic cavity and multiple hydroxyl groups on the outer surface. Bioactive molecules (e.g., β-cell targeting agent and OER stress inhibitor) can be conjugated to the cyclodextrin molecules through these hydroxyl groups by methods known in the art. Cyclodextrins have therefore already been used for the transport of anti-sense oligonucleotides in human T cell lines (Antisense Res Dev, 5:185-192, 1995) and have also been used in vivo for intracellular transport and for intracellular release or delivery of immunogenic CpG sequences (Biochem Pharmacol, 52:1537-1544, 1996). A wide variety of formulations of cyclodextrins are given in the review article by Davis and Brewster (Nature Reviews Drug Discovery 3:1023-1035, 2004).

In still other embodiments, the delivery vehicle is a dendrimer. Dendrimers comprise a category of branched materials with diverse functions that can be constructed with defined architectural and chemical structures. When decorated with bioactive molecules (e.g., β-cell targeting agent and OER stress inhibitor) through peripheral chemical groups, dendrimer conjugates are can be turned into nanomaterials possessing binding properties with the cognate receptors. Numerous methods are known in the art for decorating dendrimers with bioactive molecules and reference may be made in this regard to Liu et al. (2012, Interface focus 2(3):307-24) for an illustrative review.

7. Compositions

In accordance with the present invention, the therapeutic agents described herein can improve pancreatic β-cell ER function, improve insulin biosynthesis, increase glucose tolerance, modulate expression of oxidative stress regulatory genes, reduce stress induced by lipids, glucose, inflammatory cytokines or environmental ROS, e.g., via STAT1- and STAT3-mediated upregulation of anti-oxidant genes and suppression of oxidative stress-inducing genes, reduce ER stress, promote secretion of high quality efficacious insulin, restore glucose homeostasis and/or enhancing peripheral insulin sensitivity. Accordingly, it is proposed that these therapeutic agents will be useful for treating metabolic disorders, including pre-diabetes, diabetes (type I or type II), metabolic syndrome, obesity, non-alcoholic fatty liver disease (NAFLD), non-alcoholic steatohepatitis (NASH), diabetic dyslipidemia, hyperlipidemia, hypertension, hypertriglyceridemia, hyperfattyacidemia, and hyperinsulinemia.

The therapeutic agents described herein can be administered to a patient either by themselves, or in pharmaceutical compositions where they are mixed with a suitable pharmaceutically acceptable carrier. The choice of carrier will generally depend on whether the therapeutic agents are to be administered in solid, liquid or aerosol form, and whether they need to be sterile for such routes of administration as injection. The therapeutic agents can be administered intravenously, intradermally, transdermally, intrathecally, intraarterially, intraperitoneally, intranasally, intravaginally, intrarectally, topically, intramuscularly, subcutaneously, mucosally, orally, topically, locally, inhalation (e.g., aerosol inhalation), injection, infusion, continuous infusion, localized perfusion bathing target cells directly, via a catheter, via a lavage, in cremes, in lipid compositions (e.g., liposomes), or by other method or any combination of the forgoing as would be known to one of ordinary skill in the art (see, for example, Remington's Pharmaceutical Sciences, 18th Ed. Mack Printing Company, 1990, incorporated herein by reference). In specific embodiments, the therapeutic agents are administered systemically, suitably by injection.

The therapeutic agents may be formulated into a composition in a free base, neutral or salt form. Pharmaceutically acceptable salts, include the acid addition salts, e.g., those formed with the free amino groups of a proteinaceous composition, or which are formed with inorganic acids such as for example, hydrochloric or phosphoric acids, or such organic acids as acetic, oxalic, tartaric or mandelic acid. Salts formed with the free carboxyl groups can also be derived from inorganic bases such as for example, sodium, potassium, ammonium, calcium or ferric hydroxides; or such organic bases as isopropylamine, trimethylamine, histidine or procaine. Upon formulation, solutions will be administered in a manner compatible with the dosage formulation and in such amount as is therapeutically effective. The formulations are easily administered in a variety of dosage forms such as formulated for parenteral administrations such as injectable solutions, or aerosols for delivery to the lungs, or formulated for alimentary administrations such as drug release capsules and the like.

Pharmaceutical compositions suitable for use in the present invention include compositions wherein the therapeutic agents are contained in an effective amount to achieve their intended purpose. For any therapeutic agent used in the treatment methods of the present invention, the therapeutically effective dose can be estimated initially from cell culture assays. For example, a dose can be formulated in animal models to achieve a circulating concentration range that includes the IC50 as determined in cell culture (e.g., the concentration of a test agent, which achieves a half-maximal inhibition of β-cell OER stress or a β-cell OER stress-inducing polypeptide (e.g., IL-23, IL-24, etc.). Such information can be used to more accurately determine useful doses in humans.

Toxicity and therapeutic efficacy of such drugs can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit large therapeutic indices are preferred. The data obtained from these cell culture assays and animal studies can be used in formulating a range of dosage for use in human. The dosage of such compounds lies preferably within a range of circulating concentrations that include the ED50 with little or no toxicity. The dosage may vary within this range depending upon the dosage form employed and the route of administration utilized. The exact formulation, route of administration and dosage can be chosen by the individual physician in view of the patient's condition. (See for example Fingl et al., 1975, in "The Pharmacological Basis of Therapeutics", Ch. 1 p 1).

Generally, the dose of therapeutic agent administered to a patient should be sufficient to achieve a beneficial response in the patient over time such as an improvement in pancreatic β-cell ER function, improvement in insulin biosynthesis, increase glucose tolerance, beneficial modulation of expression of oxidative stress regulatory genes, reduction in stress induced by lipids, glucose, inflammatory cytokines or environmental ROS, e.g., via STAT1- and STAT3-mediated upregulation of anti-oxidant genes and suppression of oxidative stress-inducing genes, reduction in ER stress, increase in secretion of high quality efficacious insulin, restoration of glucose homeostasis and/or enhancing peripheral insulin sensitivity. The quantity of the drug(s) to be administered may depend on the subject to be treated inclusive of the age, sex, weight and general health condition thereof. In this regard, precise amounts of the drug(s) for administration will depend on the judgment of the practitioner. In determining the effective amount of the drug to be administered in the modulation of type 2 diabetes, the physician may evaluate tissue or cell levels of a stress-modulating cytokine, glucose levels, HbA1c levels, insulin levels, blood pressure, High Density Lipoprotein (HDL) levels, triglycerides levels, uric acid levels, weight loss etc. In any event, those of skill in the art may readily determine suitable dosages of the drugs of the invention.

Dosage amount and interval may be adjusted individually to provide plasma levels of the active agent that are sufficient to stimulate or maintain inhibition or reduction of β-cell OER stress. Usual patient dosages for systemic administration range from 0.1-2000 mg/day, commonly from 1-250 mg/day, and typically from 10-150 mg/day. Stated in terms of patient body weight, usual dosages range from 0.02-25 mg/kg/day, commonly from 0.02-3 mg/kg/day, typically from 0.2-1.5 mg/kg/day. Stated in terms of patient body surface areas, usual dosages range from 0.5-1200 mg/m$^2$/day, commonly from 0.5-150 mg/m$^2$/day, typically from 5-100 mg/m$^2$/day.

In light of the abundance of IL-22 receptor on the cell surface of a β-cell, in embodiments wherein the OER stress inhibitor is IL-22, the pharmaceutical composition is administered to a subject at a concentration of between around 0.02 to around 0.1 mg/kg/day (1.25-6 nmoles/kg/day). This is substantially below the usual doses of such therapeutics, and thus, the negative side effects associated with IL-22 administration, or the unforeseen side effects of the targeting agent, would not appear at this low dosage.

In some embodiments, therapeutic efficacy is established or monitored by determining ER stress. In this regard, ER stress markers and methods for measuring them have been previously identified and are known in the art (see, Iwawaki et al., 2004). For example, analysis of Xbp1 mRNA splicing, ATF6 nuclear translocation, eIF2α phosphorylation, and Griess test are all suitable assays for determining ER stress (see, Cunha et al., 2008). These ER stress markers may be measured using any techniques known in the art for measuring mRNA levels, protein levels, protein activity, or phosphorylation status. Exemplary techniques for measuring ER stress markers include western blot analysis, ELISA, northern blot analysis, immunoassays, quantitative PCR analysis, and enzyme activity assay (for a more detailed description of these techniques, please see Ausubel et al. Current Protocols in Molecular Biology (John Wiley & Sons, Inc., New York, 1999); Molecular Cloning: A Laboratory Manual, 2nd Ed., ed. by Sambrook, Fritsch, and Maniatis (Cold Spring Harbor Laboratory Press: 1989); each of which is incorporated herein by reference). The levels of ER stress markers may be determined from any cells in the subject's body. In certain embodiments, the cells are cells from a pancreatic β-cell. The cells may be obtained in any manner including biopsy or surgical excision. Oxidative stress can be measured by chemical assays assessing the presence of reactive oxygen or reactive nitrogen species such as, but not limited to, $O_2^-$, $H_2O_2$, NO, OH and $ONOO^-$, or metabolites thereof. These assays can be applied to cultured β-cells, cultured pancreatic islets or to tissue samples including histological sections. Another way of determining the tissue specificity of OER stress inhibitors incorporating, for example, IL-22 or IL-10 is to determine the relative changes in STAT1 and STAT3 phosphorylation in pancreatic β-cells versus other IL-22R1-expressing cell type in the intestinal epithelium, respiratory epithelium, cutaneous epithelium and liver. Successful targeting to the OER stress inhibitor will be accompanied by an increase in the ratio of STAT1/3 phosphorylation between β-cells and the other IL-22R1-expressing cell types versus native IL-22.

In following, for example, the progression of a disease associated with OER stress, or the effectiveness of present invention in therapy, one may determine the levels of one, two, three, four, five, or six OER stress markers. In certain embodiments, the level of only one OER stress marker is determined. In other embodiments, the levels of at least two OER stress markers are determined. In yet other embodiments, the levels of at least three OER stress markers are determined.

In some embodiments, the therapeutic agents of the present invention are administered concurrently with one or more ancillary agents or treatments that are known or approved for treating a metabolic disorder. For example, an individual that is obese may be administered a composition of the invention in addition to another therapy for obesity. Additional obesity therapies include dietary therapy, physical therapy (exercise), drug therapy, surgery, and behavioral therapy, for example. Exemplary anti-obesity drug therapies include, for example, Xenical Orlistat®, phentermine, sibutramine (Meridia®), ATL-962, A39677, L750355, CP331648, topiramate, axokine, dexamphetamine, phenylpropanolamine, famoxin, or mazindol. Exemplary surgeries include liposuction and gastric bypass, for example.

For individuals with diabetes, for example, exemplary additional compounds for therapy include one or more of the following: metformin, glyburide, glimepiride, glyburide, glipyride, glipizide, chlorpropamide, gliclazide, acarbose, miglitol, pioglitazone, troglitazone, dapagliflozin, rosiglitazone, sitagliptin, Avandaryl (rosiglitazone+glimepiride), Avandamet (rosiglitazone and metformin), Duetact (pioglitazone and glimepiride), Glucovance (glyburide/metformin), Metaglip (glipizide+metformin), insulin, GI-262570, isaglitazone, taspoglutide, albiglutide, JTT-501, NN-2344, L895645, YM-440, R-119702, A39677, repaglinide, nateglinide, KAD1129, APR-H039242, GW-409544, KRP297, AC2993, Exendin-4, liraglutide, LY307161, NN2211 or LY315902, Vildagliptin, glucosidase inhibitor, sodium-glucose co-transporter 2 (SGLT2) inhibitors such as canaglifozin and pramlintide. Other therapies for diabetes include an improvement in diet and exercise.

For individuals with high triglycerides or fatty acid levels, exemplary additional compounds for therapy include one or more lipid-modulating agents such as but not limited to pravastatin, lovastatin, simvastatin, atorvastatin, cerivastatin, fluvastatin, nisvastatin, ZD-4522, fenofibrate, gemfibrozil, clofibrate, implitapide, CP-529,414, avasimibe, TS-962, MD-700, or LY295427.

8. Therapeutic Uses

The present invention provides methods for improving pancreatic β-cell ER function, improving insulin biosynthesis, increasing glucose tolerance, modulating expression of oxidative stress regulatory genes, reducing stress induced by lipids, glucose, inflammatory cytokines or environmental ROS, e.g., via STAT1- and STAT3-mediated upregulation of anti-oxidant genes and/or suppression of oxidative stress-inducing genes, reducing ER stress, promoting secretion of high quality efficacious insulin, restoring glucose homeostasis and/or enhancing peripheral insulin sensitivity.

Thus, in some embodiments, the invention provides methods for improving pancreatic β-cell ER function in a β-cell, comprising contacting the β-cell with a pancreatic β-cell ER function-improving amount of a therapeutic agent as broadly described above and elsewhere herein.

In some embodiments, the invention provides methods for improving insulin biosynthesis in a β-cell, comprising contacting the β-cell with an insulin biosynthesis-improving amount of a therapeutic agent as broadly described above and elsewhere herein.

In some embodiments, the invention provides methods for modulating expression of oxidative stress regulatory genes, comprising contacting the β-cell with an oxidative stress regulatory gene expression-modulating amount of a therapeutic agent as broadly described above and elsewhere herein.

In some embodiments, the invention provides methods for reducing stress induced by lipids, glucose, inflammatory cytokines or environmental ROS, e.g., via STAT1- and STAT3-mediated upregulation of anti-oxidant genes and/or suppression of oxidative stress-inducing genes in a β-cell, comprising contacting the β-cell with an amount of a therapeutic agent as broadly described above and elsewhere herein, which is effective for reducing that stress.

In some embodiments, the invention provides methods for reducing ER stress in a β-cell, comprising contacting the β-cell with an ER-stress-reducing amount of a therapeutic agent as broadly described above and elsewhere herein.

In some embodiments, the invention provides methods for increasing glucose tolerance in a subject, comprising administering to the subject a glucose tolerance-increasing amount of a therapeutic agent as broadly described above and elsewhere herein.

In some embodiments, the invention provides methods for promoting secretion of high quality insulin from a β-cell, comprising contacting the β-cell with an amount of a therapeutic agent as broadly described above and elsewhere herein, which is effective for promoting that secretion.

In some embodiments, the invention provides methods for increasing glucose tolerance in a subject, comprising administering to the subject a glucose tolerance-increasing amount of a therapeutic agent as broadly described above and elsewhere herein.

In some embodiments, the invention provides methods for restoring glucose homeostasis in a subject, comprising administering to the subject a glucose homeostasis-restoring amount of a therapeutic agent as broadly described above and elsewhere herein.

In some embodiments, the invention provides methods for enhancing insulin sensitivity in a subject, comprising administering to the subject an insulin sensitivity-enhancing amount of a therapeutic agent as broadly described above and elsewhere herein.

In some embodiments, the invention provides methods for stimulating or enhancing weight loss in a subject, comprising administering to the subject a weight loss-stimulating or -enhancing amount of a therapeutic agent as broadly described above and elsewhere herein.

In accordance with the present invention, it is proposed that these therapeutic agents will be useful for treating metabolic disorders, including pre-diabetes, diabetes (type I or type II), metabolic syndrome, obesity, non-alcoholic fatty liver disease (NAFLD), non-alcoholic steatohepatitis (NASH), diabetic dyslipidemia, hyperlipidemia, hypertension, hypertriglyceridemia, hyperfattyacidemia, and hyperinsulinemia. Accordingly, the present invention provides methods for treating a metabolic disorder in a subject, comprising administering to the subject an effective amount of a therapeutic agent as broadly described above and elsewhere herein.

In particular aspects of the invention, an individual is given one or more compositions of the present invention and the individual is assessed for an improvement in at least one symptom of the metabolic disorder. For example, in particular embodiments when the metabolic disorder is obesity, an improvement in obesity may be determined during and/or following treatment with one or more compositions of the invention. An improvement in obesity may be measured by any standard means, but in particular aspects the improvement in obesity is measured by weight measurement, body mass index (BMI) measurement, and/or body part size measurement (such as waist measurement), for example. Exemplary methods for calculating BMI includes dividing a person's body weight in kilograms by their height in meters squared (weight [kg] height $[m]^2$). For example, for Caucasians, a BMI of 30 or more is considered obese and a BMI between 25 and 29.9 is considered overweight.

In other aspects of the invention, an individual with diabetes is tested for an improvement following administration to the individual of the therapy of the invention. In one specific embodiment, the monitoring of diabetes occurs by blood test. For example, the blood test may measure the chemical A1C. The higher the blood sugar, the higher the A1C level will be. The American Diabetic Association recommends that diabetics maintain a A1C of less than 7.0% to reduce the complications associated with diabetes. (The American Association of Clinical Endocrinologists recommend 6.5% or less).

In some cases, cholesterol (including HDL and/or LDL cholesterol) and/or triglycerides are measured, such as by standard means in the art. In specific cases, a fasting lipoprotein profile is performed, such as by standard means in the art.

In order that the invention may be readily understood and put into practical effect, particular preferred embodiments will now be described by way of the following non-limiting examples

Example 1

Identification of Cytokines that Drive Er Stress

β-cell specific deficiency of a critical Unfolded Protein Response (UPR) transcription factor, Xbp1, decreases insulin secretion, impairs proinsulin processing and increases serum proinsulin, resulting in hyperglycemia and glucose intolerance, phenocopying T2D. It was therefore hypothesized that inflammation-induced ER stress underpins β-cell dysfunction in T2D and impairs the quality and quantity of secreted insulin. Protein misfolding activates the IRE-1 endoribonuclease that specifically splices Xbp1 mRNA, and therefore Xbp1-splicing is a direct measure of the UPR and ER stress.

Screening a panel of proinflammatory cytokines using the ERAI reporter of Xbp1-splicing transfected into murine MIN6N8 β-cells, identified several cytokines as inducing ER stress. Specifically, IL-23, IL-24 and IL-33 were determined to be potent inducers of ER stress, with a lower stress response induced by IL-1β, MIP-2α, IL-17A and IFN-γ and IFN-β (FIG. 1A).

It was shown using pharmacological inhibitors that each of these cytokines induces ER stress by distinct mechanisms. IL-23 acts via STAT3, IL-24 via STAT1 and IL-33 via STAT1 and NFκB. All of the ER stress-inducing cytokines trigger production of reactive oxygen species (ROS) and/or nitric oxide (NO) (FIG. 1C). Pharmacological inhibitors showed the various cytokines induced ER stress via oxidative stress with almost complete inhibition of ER stress with a combination of GSH, SOD1 and L-NMMA. ER stress was generated by downstream activation of a range of transcription factors, for example, IL-23 via STAT3, IL-24 via STAT1, and IL-33 requires both STATS and NFκB (see, Table 3, below). Thus multiple cytokines induce classical ER stress in β-cells by induction of oxidative stress involving both reactive oxygen and reactive nitrogen species.

Increased pancreatic ER stress in obese diabetic mice coincides with increased serum proinsulin, as shown in FIGS. 1E-H. Localization of the ER stress chaperone, Grp78, showed that most ER stress occurs in the highly secretory β- and α-cells (see, FIG. 1I), and accompanied by a decrease in β-cell insulin content. Additionally, a relocation of some α-cells from the periphery to the center of the islets was observed.

Materials and Methods

In Vitro Assessments of Er/Oxidative Stress

MIN6N8 cells are maintained in line with standard protocols. Cells are transfected with either the ERAI reporter plasmid (F-XBP1ΔDBD-Venus), or the ATF6-GFP plasmid (ADGENE), using LIPFECTAMINE 2000 according to the manufacturer's instructions.

MIN6N8 cells comprising the ERAI reporter plasmid exhibit negligible fluorescence in the absence of an ER stressor. On induction of ER stress, splicing of XBP2 mRNA by IRE1a results in the translation of Venus, but not an active form of XBP1. Fluorescence was measured (excitation: 485 nm; emission: 520 nm) using the POLARstar Omega plate reader and cells were treated 48 h after transfection. The results are normalized with Gapdh expression as fold of vehicle-treated control (Con) cells.

Activation of ATF6 was assessed as follows: the area in pixels per square millimeter co-stained ATF6 and DAPI (blue and green), and total ATF6 staining (green) was determined in 5 fields of view for each section (n=6 for each condition) using IMAGEJ software version 1.45s. Data are presented as the percentage of ATF6 and DAPI co-fluorescence to the total ATF6 fluorescence. Phosphorylation of Ser-51 of eiF2 α was determined by an AlphaScreen assay as per the manufacturer's instructions (PERKIN-ELMER).

TABLE 3

| Cytokine | GSH | SOD1 | L-NMMA | RG + SOD1 + L-NMMA | Required Transcription Factors/Kinases | Excluded Transcription Factors/Kinases |
|---|---|---|---|---|---|---|
| | % Inhibition of ER Stress (Xbp1 splicing) | | | | | |
| IFNγ | 15 | 74 | 87 | 98 | NFκB | STAT1 |
| IL-1β | 16 | 96 | 93 | 100 | NFκB | ERK, JNK |
| IL-17A | 0 | 65 | 83 | 95 | NFκB, JNK[1] | ERK |
| IL-23 | 87 | 95 | 78 | 96 | STAT3 | STAT1, STAT5 |
| IL-24 | 6 | 59 | 92 | 100 | STAT1 | STAT3 |
| IL-33 | 13 | 74 | 90 | 96 | NFκB, STAT5[2] | ERK, JNK, STAT1, STAT3 |
| MIP-2α | 7 | 88 | 95 | 97 | None identified | ERK, JNK, NFκB, STAT1, STAT3, STAT5 |

GSH = reduced glutathione (scavenger of oxygen radicals);
SOD1 = superoxide dismutase (enzyme that deactivates OH⁻);
L-NMMA = N^G-Methyl-L-arginine (nitric oxide inhibitor).
Note that the combination of inhibitors almost completely prevents cytokine-induced ER stress.
Transcription factors were inhibited with both pharmacological inhibitors and siRNA to determine which of the known transcription factors downstream of each cytokine were required to induce ER stress.
[1]IL-17A can induce ER stress by either NFκB or JNK, but more potently when both transcription factors are involved.
[2]IL-33 induction of ER stress requires both NFκB and STAT5.

Figure 2:
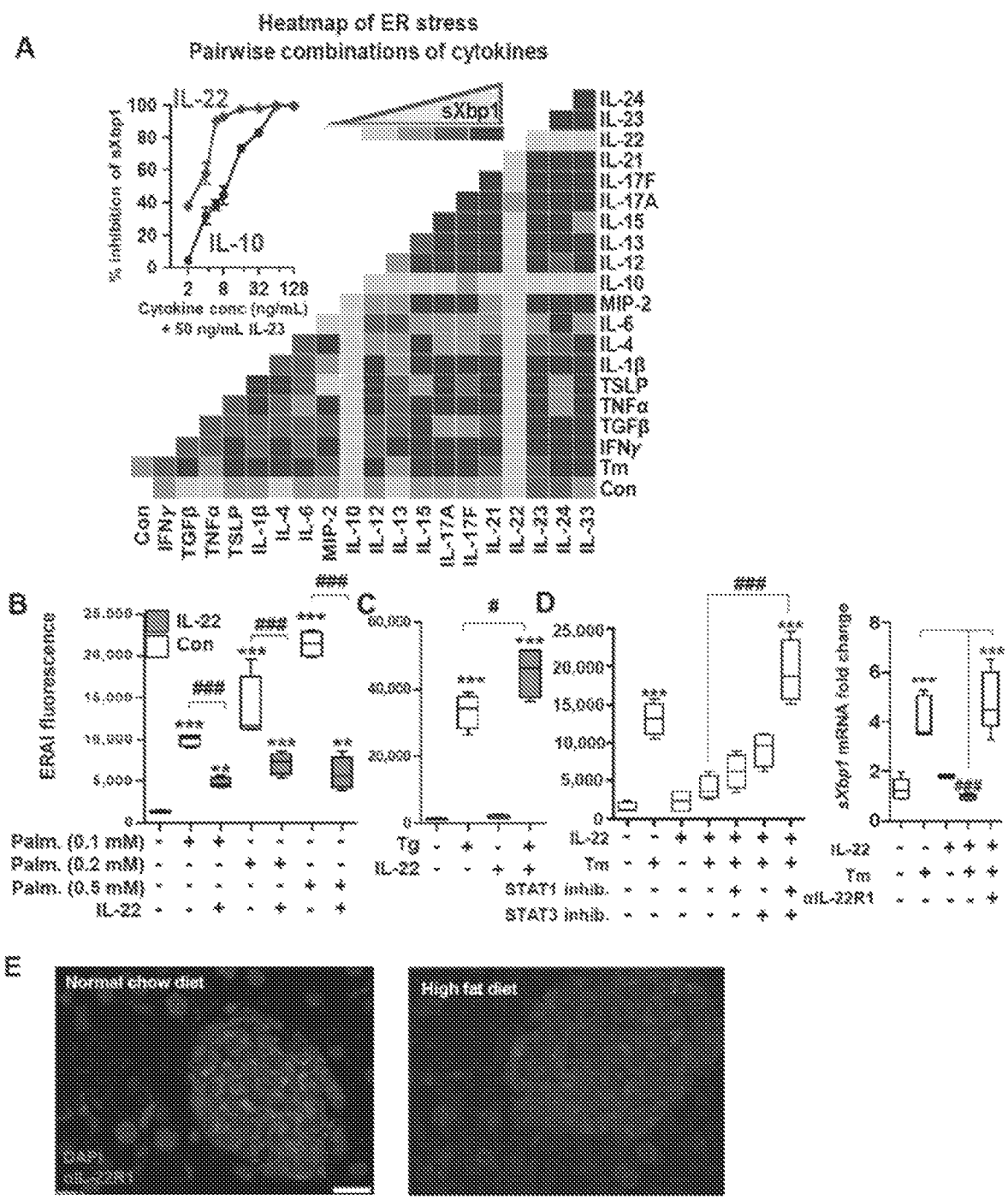
FIG. 2: IL-22 suppresses β-cell ER stress. (A-D) ERAI-XBP1-reporter fluorescence in MIN6N8 cells. (A) Heat map of ERAI-reporter fluorescence in MIN6N8 cells exposed to pair-wise combinations of cytokines, or a 6 hour treatment with 10 μg/mL tunicamycin (Tm). Inset shows IL-10 and IL-22 dose-response for suppression of IL-23-induced ER stress. (B,C) Cells were exposed to 0.1-0.5 mM palmitic acid (B) or 5 μM thapsigargin (Tg) (C)±IL-22 for 24 or 6 hours, respectively. (D, left panel) Cells were treated with IL-22 or Tm±inhibitors for STAT1 (FLUDARABINE) and/ or STAT3 (VI S31-201) for 6 hours. (D, right panel) MIN6N8 cells were treated with Tm±IL-22±anti-IL-22R1 antibody for 6 hours and Xbp1 splicing assessed. (E) IL-22R1 expression determined by immunofluorescence and confocal microscopy in pancreata from mice fed normal chow or a high fat diet for 22 weeks; scale bar=25 μm.

Although these cytokines have not previously been considered to be involved in pancreatic pathophysiology in T2D, expression of all of the ER stressor cytokine genes is increased in the pancreas of obese mice on a high fat diet (HFD), as shown in FIG. 2. IL-24 and IL-33 are amongst the 20 most highly upregulated genes in human type 2 diabetes, showing relevance for the human disease.

The Griess reagent method was performed according to the manufacturer's instructions (MOLECULAR PROBES) to assess the intracellular levels of nitric oxide. 5-(and -6-)-carboxy-2,7-dichlorofluorescein diacetate (DCFDA) assay was used to determine the intracellular levels of $H_2O_2$ as previously described (Sakon et al., 2003). Cells were treated with glucose or recombinant cytokines at the concentrations indicated in the figure legends, or with 5 µM thapsigargin (SIGMA-ALDRICH) or 10 µg/mL tunicamycin (SIGMA-ALDRICH) or 0.1-0.5 mM Palmitate (SIGMA-ALDRICH) for the times indicated in the legends. ROS was inhibited using the dihydroethidium (DHE) fluorescent cell-permeable probe (SIGMA-ALDRICH). MIN6N8 cells plated at $2 \times 10^6$/mL were incubated with 3 µM DHE and subsequently treated with DMSO (control), 50 ng/mL IL-23 for 30 minutes±50 mg/mL IL-22 at the same time or 30 minutes prior to IL-23.

To inhibit transcription factors the following specific inhibitors (and concentrations) were used:

TABLE 4

| Transcription Factor | Inhibitor | Concentration (µM) |
|---|---|---|
| STAT1 | Fludarabine (MERK) | 50 |
| STAT3 | VI S31-201 (SANTA CRUZ) | 50 |
| STAT5 | 573108 (MERK) | 50 |
| JNK | Inhibitor V (MERK) | 10 |
| ERK | FR18020 (MERK) | 5 |
| NFKB | BAY11-7085 (CELL SIGNALING) | 20 |

Cytokine Assay to Determine Impact on Er Stress

MIN6N8 cells were exposed to a panel of cytokines to determine the effect of each cytokine on ER stress. ER stress was measured using the above-described method. Specifically, the cells were exposed to either a 24 hour treatment of any one of 1.6 mM glucose (hi glucose), 10 µM $H_2O_2$, 0.5 mM palmitic acid or 50 ng/mL cytokines; or a 6 hour treatment with 10 µg/mL tunicamycin or 5 µM thapsigargin. Tunicamycin is removed after 6 hours as prolonged treatment induced cell death.

Cytokine Assay to Determine Impact on Er Stress

MIN6N8 cells were exposed to a panel of cytokines to determine the effect of each cytokine on ER stress. ER stress was measured using the above-described method. Specifically, the cells were exposed to either a 24 hour treatment of any one of 1.6 mM glucose (hi glucose), 10 µM $H_2O_2$, 0.5 mM palmitic acid or 50 ng/mL cytokines; or a 6 hour treatment with 10 µg/mL tunicamycin or 5 µM thapsigargin. Tunicamycin is removed after 6 hours as prolonged treatment induced cell death.

Quantitative Real Time-PCR (qRT-PCR)

Tissue samples were snap-frozen, and homogenized in TRIZOL using FASTPREP (MP BIOMEDICAL). RNA was isolated using High Pure RNA isolation kit (ROCHE), followed by cDNA synthesis using iScript (BIORAD) containing oligo(dT) and random hexamers. QPCR SYBR Green (INVITROGEN) was used for quantitative PCR using a HT7900 (ABI SYSTEMS). RoX was used as a normalization reference. Results were analyzed using SDS software (version 2.3) (ABI SYSTEMS). Primer efficiencies were determined using cDNA dilutions and primer dilutions for the genes of interest. All the data was normalized against the housekeeping gene, Gapdh, and expressed as a fold difference to the mean of relevant control samples.

Primers for PCR analysis were as follows:

sXBP-1:
    [SEQ ID NO: 192]
    forward - 5' CTGAGTCCGCAGCAGGTG 3';

[SEQ ID NO: 193]
    reverse - 5' TGCCCAACAGGATATCAGACT 3';

GRP78:
    [SEQ ID NO: 194]
    forward - 5'CACAGTGGTGCCTACCAAGA 3';

[SEQ ID NO: 195]
    reverse - 5' TGATTGTCTTTTGTCAGGGGT 3'.

Oxidative Stress Array:

cDNA from MIN6N8 cells treated with DMSO or 50 ng/mL IL-22 was compared using the oxidative stress $RT^2$ Profiler PCR Array (QIAGEN, PAMM-065Z). Data were analyzed using $RT^2$ Profiler PCR Array data analysis software.

Quantification of Gene Expression

Total RNA was extracted from animal tissues by homogenizing in TRIzol and separated via chloroform phase separation. RNA was purified using High Pure RNA isolation kit (ROCHE) as per the manufacturer's instructions, including DNASE treatment. Extraction purity was assessed by NANODROP, ensuring the expected $A_{260/280}$ value for RNA between 1.8 and 2.0. Reverse transcription was performed on 1 µg of RNA using 5×ISCRIPT reaction mix and ISCRIPT reverse transcriptase (BIORAD). Quantitative, reverse transcription polymerase chain reaction (qRT-PCR) was performed to quantify expression of PVM gene Src homology (SH), using specific exon-spanning primer sequences and amplified with SYBR Premix Ex TAQ II polymerase (TAKARA). All gene expression was quantified in duplicate using a Viia 7 Real Time PCR System (APPLIED BIOSYSTEMS) and relative fold changes were calculated using the $2^{-\Delta\Delta Ct}$ method, comparing to the mean of naïve uninfected mice after normalizing to the β-actin housekeeping gene ACTB.

Statistical Analysis

In vitro experiments were powered to see a 2.0 standard deviation effect size in a variety of primary outcome measures. Statistical analysis was performed using GRAPHPAD PRISM version 5.01 (GRAPHPAD SOFTWARE, INC). Differences between groups were assessed by using parametric tests after confirmation of a normal distribution by probability plots (one-way ANOVA with post-test or, where appropriate, a two-tailed Student t test, as described in individual figure legends).

Example 2

Identification of Cytokines that Inhibit ER Stress and/or Oxidative Stress

Exposing β-cells to pair-wise combinations of cytokines revealed that IL-22 and IL-10 inhibit ER stress, detected by the ERAI reporter gene for splicing of the Xbp1 mRNA, initiated by cytokines or the N-glycosylation inhibitor, tunicamycin (see, FIG. 2A). IL-22 is the most potent suppressor with efficacy as low as around 5 ng/mL in MIN6 β-cells.

IL-22 also inhibits ER stress induced with the free fatty acid (FFA), palmitic acid (see, FIG. 2B), which induces β-cell oxidative and ER stress. IL-22 alone does not appear to activate the UPR, however, when ER stress is induced with thapsigargin, which disturbs ER $Ca^{2+}$, IL-22 increases UPR activation (see, FIG. 2C). Inhibitor of both STAT1 and STAT3 transcription factors is required to block IL-22-mediated suppression or inhibitor of ER stress (see, FIG. 2D).

The pancreas has the highest tissue expression of the IL-22 receptor (IL-22R1), particularly in β- and α-cells, and IL-22 inhibition of β-cell ER stress is completely inhibited by an IL-22R1 antibody (see, FIG. 2D).

Figure 3:
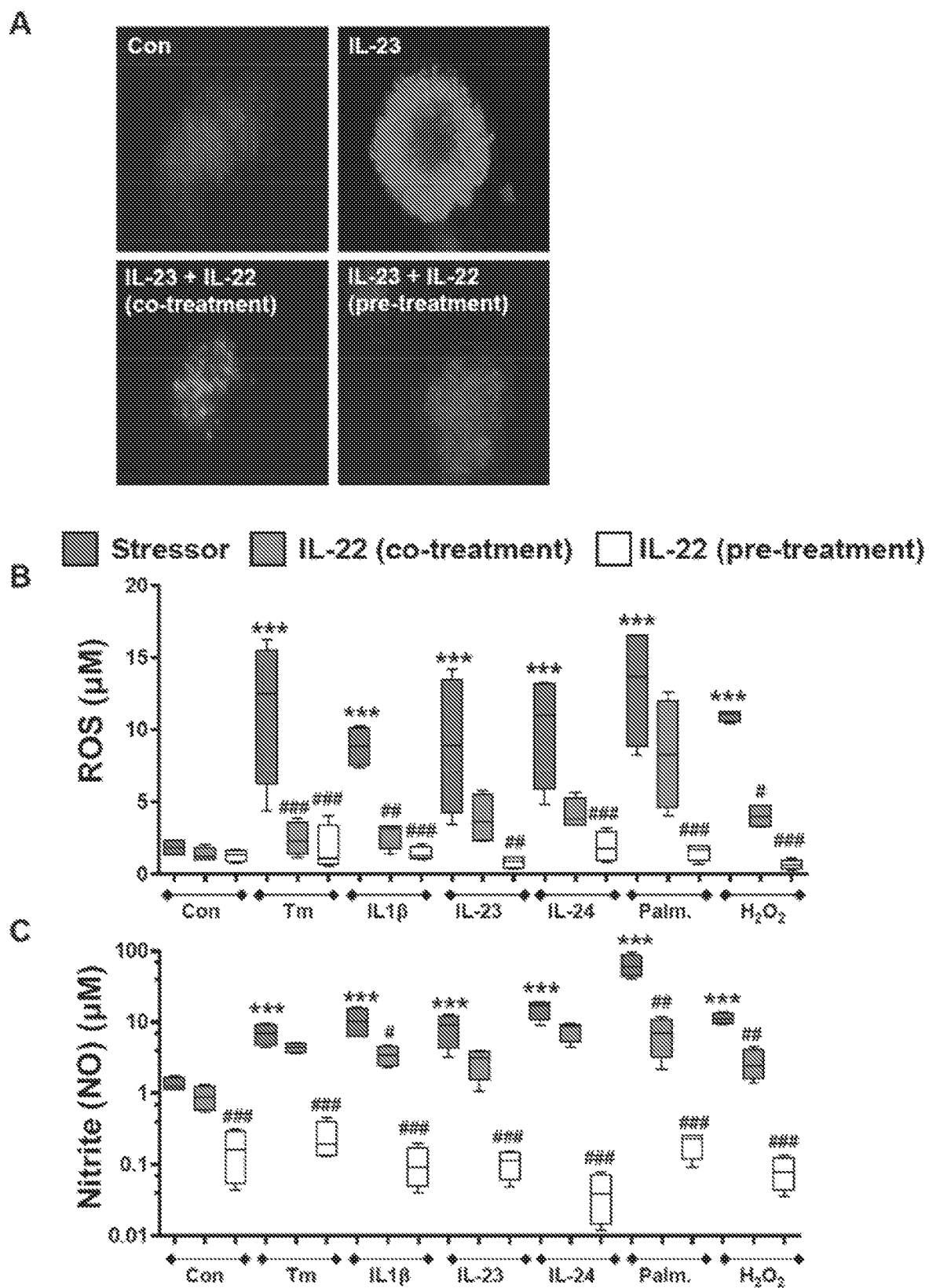
FIG. 3: IL-22 suppresses β-cell oxidative stress. (A) MIN6N8 cells loaded with dihydroethidium (DHE) which fluoresces red and binds DNA after oxidation were exposed to 50 ng/mL IL-23 for 30 min±50 ng/mL IL-22 at the same time or 30 min prior to IL-23. DAPI staining (blue) used to visualize nuclei. Confocal micrographs after 30 min exposure; scale bar=100 μm. (B,C) Concentration of ROS (B) and NO (C) in MIN6N8 cells treated with 16.6 mM glucose (Hi glucose), 10 μM $H_2O_2$, 0.5 mM palmitic acid or 50 ng/mL cytokines±50 ng/mL IL-22 administered 30 min before or at the same time as the stressors. Data shown are at the peak time of production in non-IL-22-treated cells (30 min, 2 hours or 8 hours). Color reproductions of FIG. 3 are available upon request.
Figure 4A:
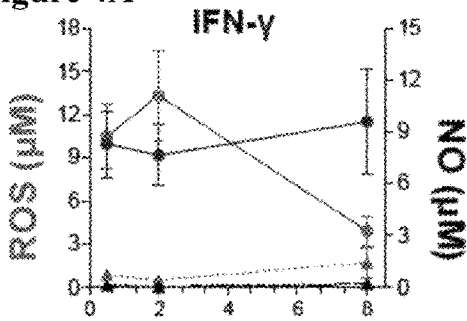
FIGS. 4A-4T: Cytokines induce reactive oxygen species (ROS) and nitric oxide (NO) production in β-cells. MIN6N8 murine β-cells were exposed to cytokines (IFN-γ (A), IL-1β (B), IL-10 (C), IL-12 (D), IL-17a (E), IL-17f (F), IL-24 (G), IL-33 (H), TNF-α (I), TSLP (J), IL-4 (K), IL-6 (L), IL-13 (M), IL-15 (N), IL-21 (O), IL-23 (P), MIP-2 (Q), TGF-β (R)), $H_2O_2$ (S) or palmitate (T). ROS (shown in grey circles) was assessed by DCFDA method and nitrite (NO, black circles) was measured by using the Griess assay. IL-22 pretreatment markedly reduced the production of ROS (grey triangles) and NO (black triangles). Note the y-axes have differing scales for different stressors.
Figure 4B:
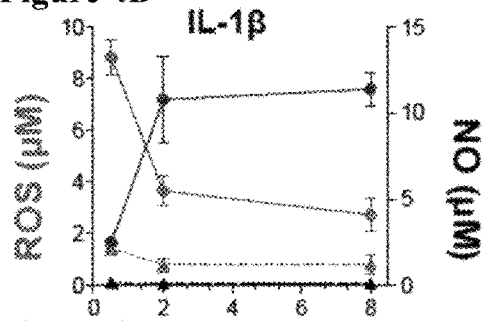
Figure 4C:
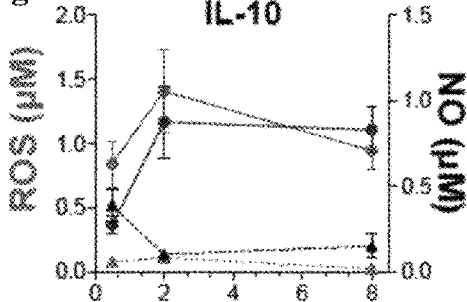
Figure 4D:
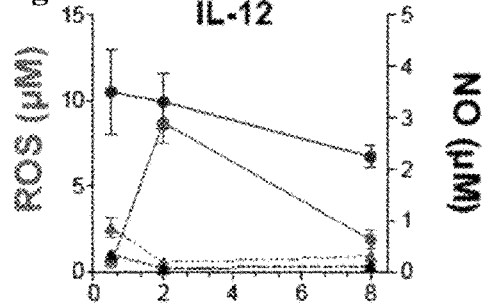
Figure 4E:
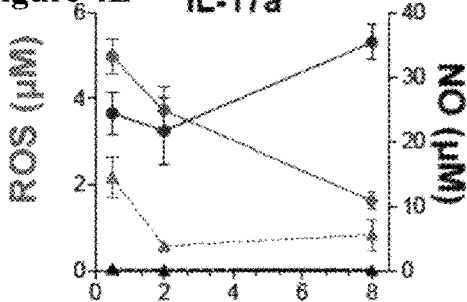
Figure 4F:
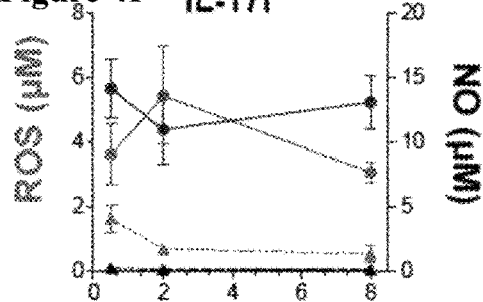
Figure 4G:
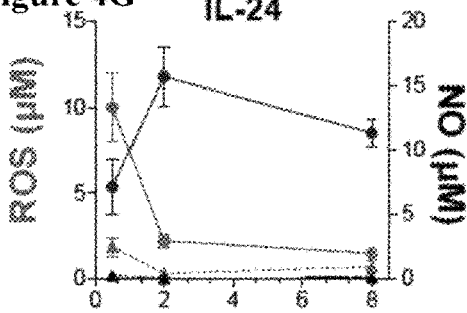
Figure 4H:
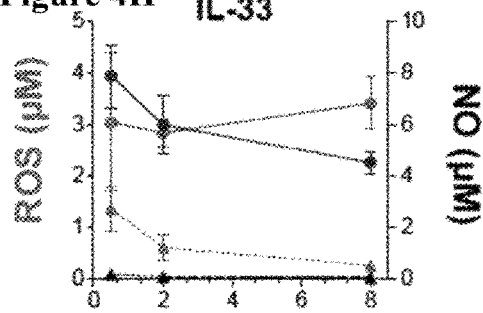
Figure 4I:
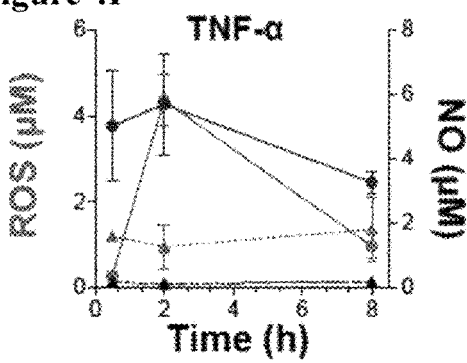
Figure 4J:
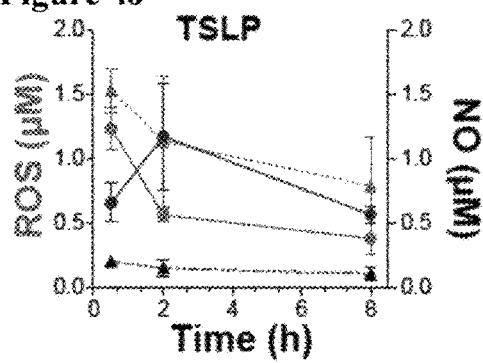
Figure 4K:
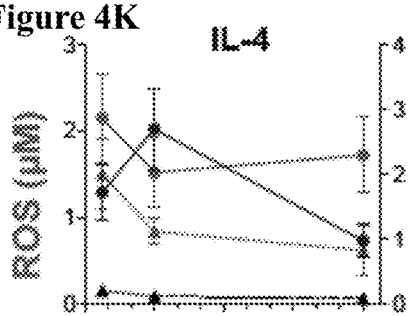
Figure 4L:
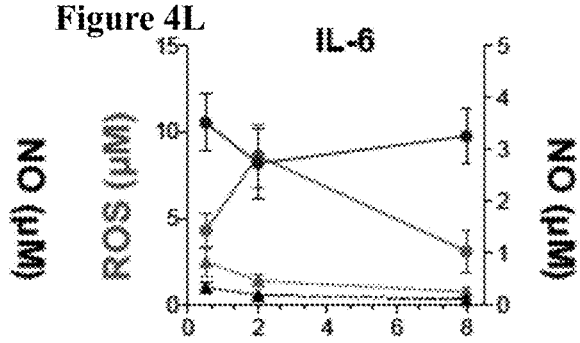
Figure 4M:
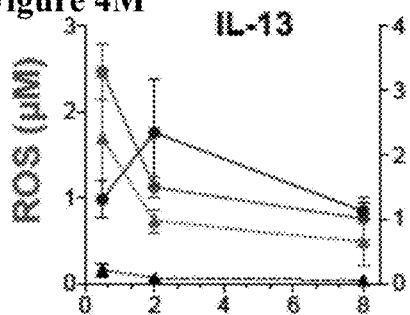
Figure 4N:
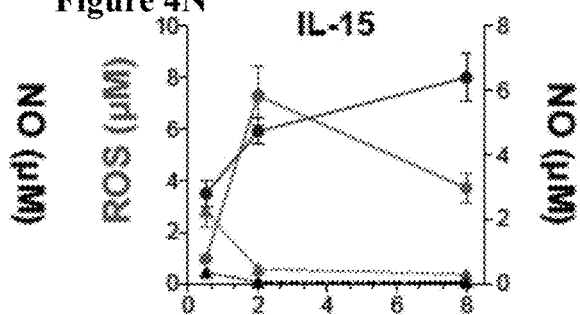
Figure 4O:
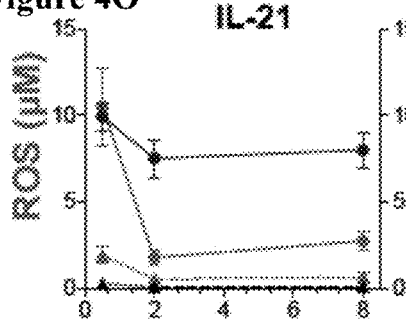
Figure 4P:
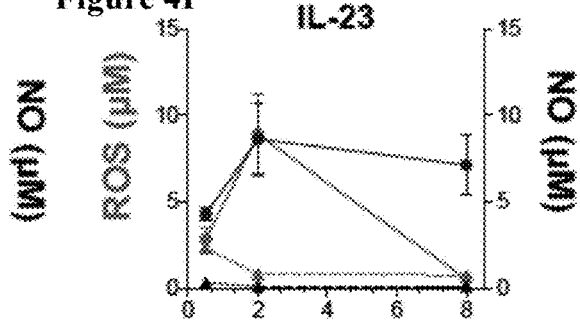
Figure 4Q:
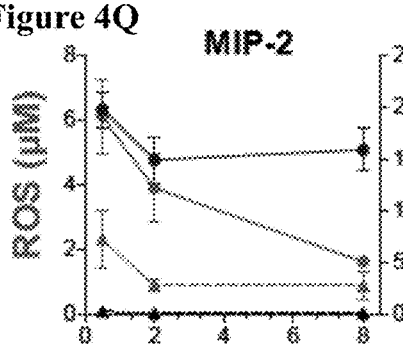
Figure 4R:
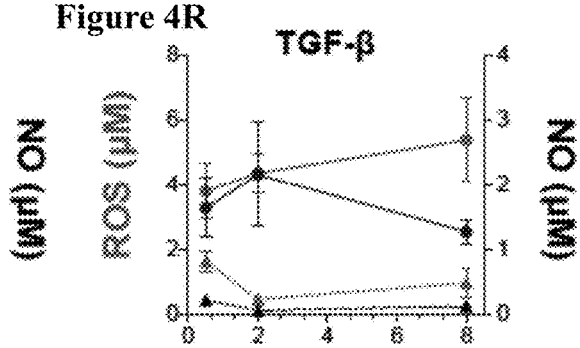
Figure 4S:
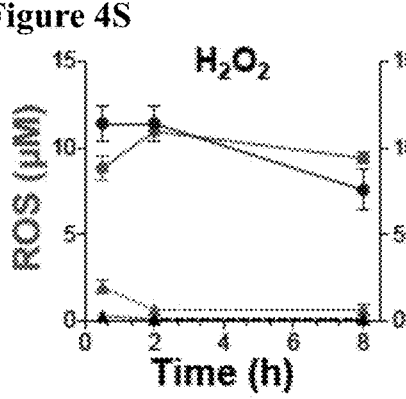
Figure 4T:
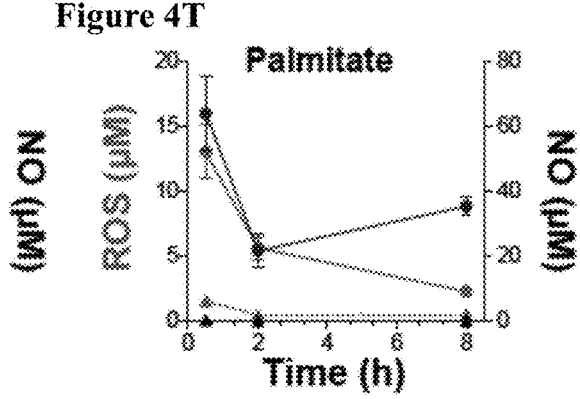

It was hypothesized that IL-22 prevented cytokine-induced ER stress by inhibiting oxidative stress. IL-23 induced oxidation of the fluorescent dye dihydroethidium (DHE), which is activated by $O_2$, progressively over 30 minutes and concomitant exposure to IL-22 reduced the degree of oxidation and the number of cells affected. Notably, a 30-minute pre-exposure to IL-22 completely prevented DHE oxidation (see, FIG. 3A). IL-22 represses the production/accumulation of ROS and NO in β-cells exposed to inflammatory cytokines, FFA, tunicamycin or $H_2O_2$, and decreased basal NO production in unstressed cells (see, FIGS. 3B,C, and FIG. 4).

Figure 5A:
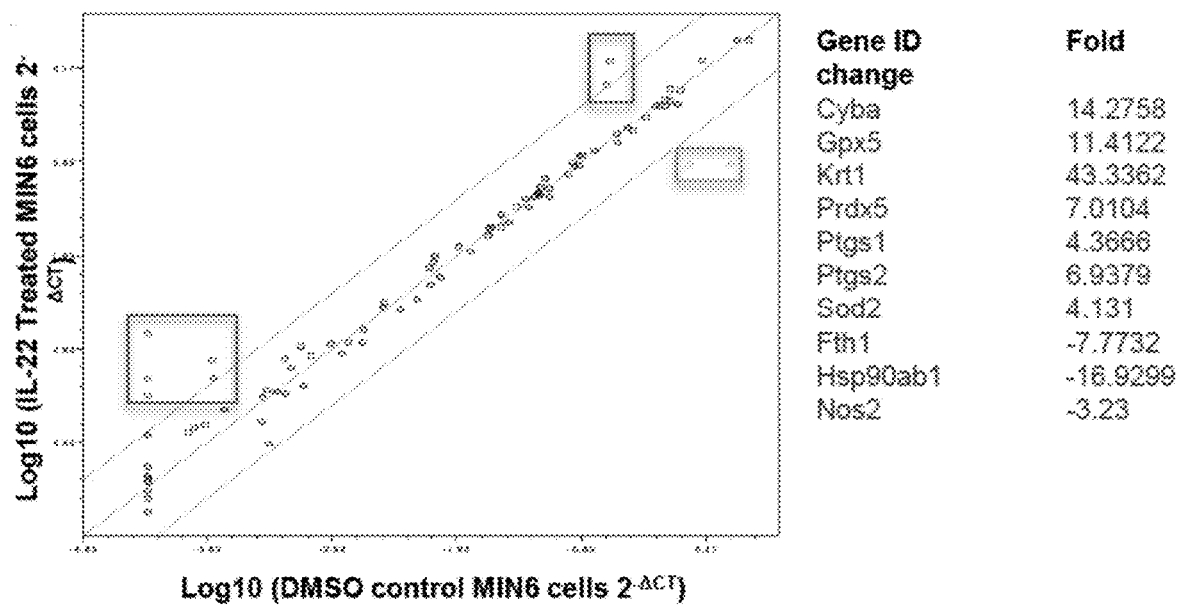

Given that IL-22 acts via transcription factors, the changes in expression of oxidative stress pathway genes in non-stressed β-cells treated with IL-22 were assessed using a RT-PCR array (see FIG. 5A). The results confirmed candidate genes by qRT-PCR (see, FIG. 5B). IL-22 down-regulates three key oxidative stress inducing genes: Nos2 (nitric oxide synthase-2/iNos, catalyzes NO production), Hsp90ab1 (heat shock protein involved in peroxynitrite production), and Fth1 (ferritin heavy chain 1, a carrier of $Fe^{3+}$).

Concomitantly, IL-22 upregulated the antioxidant genes Gpx5 (glutathione peroxidase-5), Prdx5 (peroxiredoxin-5), and Sod2 (superoxide dismutase-2), the cyclooxygenases Ptgs1 and Ptgs2 (COX-1 and COX-2), and Cyba (the $p22^{phox}$ regulatory component of NADPH-oxidase). Thus IL-22 regulated multiple genes involved in the oxidative stress pathway explaining its ability to suppress both oxidative and ER stress.

Materials and Methods

Experiments to assess ER and/or oxidative stress, and methods of qRT-PCT and/or quantifying gene expression were performed as described for Example 1. Xbp1 splicing is assessed by qRT-PCR, with normalization versus Gapdh, and expression presented as fold of vehicle-treated control cells.

ER Stress Normalization by IL-22 Cotreatment or Pretreatment

To determine whether IL-22 was sufficient to prevent the increase in oxidative stress caused by known stressors, for example dihydroethidium (DHE), MIN6N8 cells were exposed to 50 ng/mL IL-23 for 30 minutes±50 ng/mL IL-22 at the same time, or 30 minutes prior to the IL-23 treatment. Superoxide generation was measured using DHE, which fluoresces red and binds DNA after oxidation. Time-lapse imaging (3 frames/min for 30 minutes) was utilized to determine the formation of superoxide (DHE-conversion/fluorescence) in cells after treatment. DAPI fluorescence was captured to visualize nuclei.

The concentration of ROS and NO in MIN6N8 cells treated with 16.6 mM glucose (high glucose), 10 μM $H_2O_2$, 0.5 mM palmitic acid or 50 ng/mL cytokines±50 ng/mL IL-22 either at the same time, or 30 minutes prior to the stressor treatment.

Example 3

Acute and Chronic ER Stress-Induced and Suppression of Insulin Secretion is Prevented by IL-22

Acute ER Stress

Figure 6:
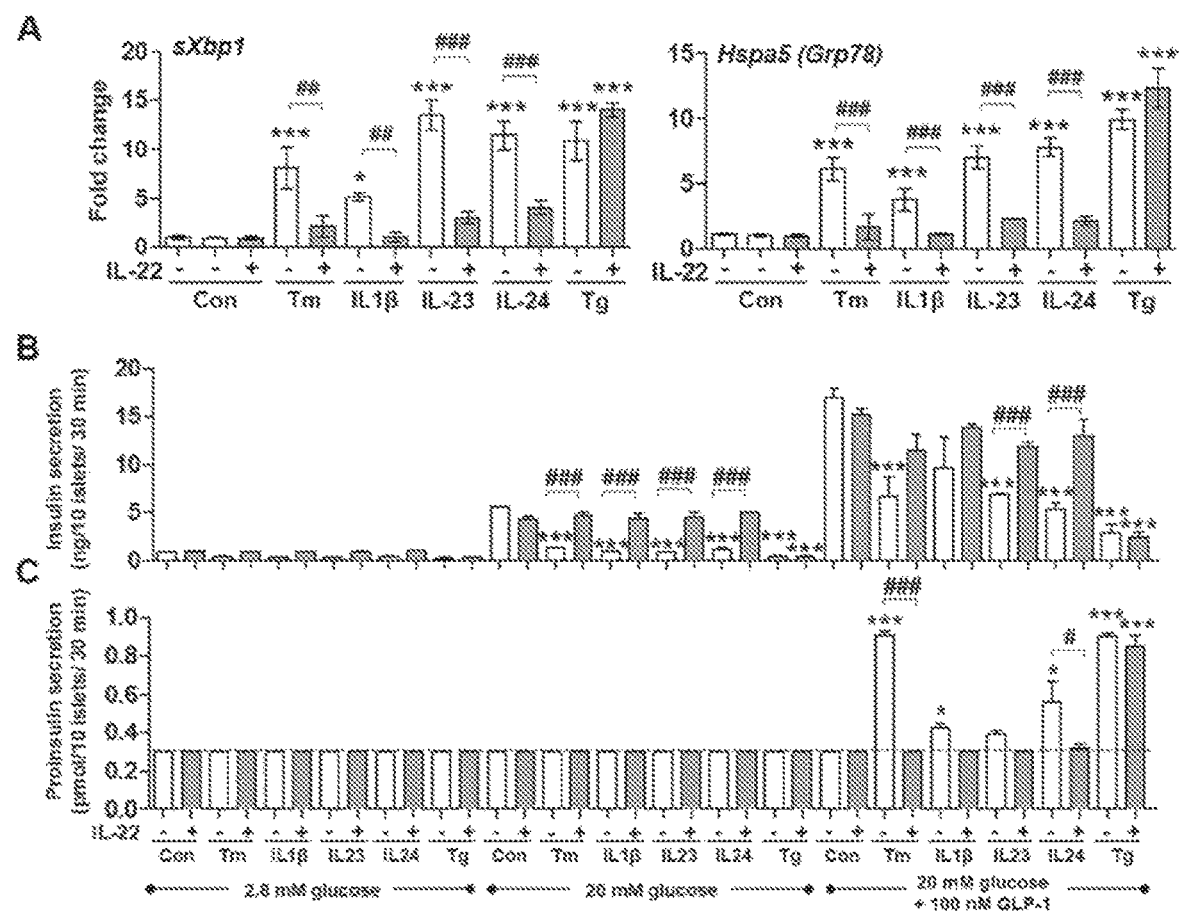
FIG. 6: Cytokine-regulated oxidative and ER stress affects islet insulin secretion. sXbp1 and Hspa5mRNA (A), insulin (B) and proinsulin (C) secretion from healthy islets cultured for 6 hours in tunicamycin (Tm) or thapsigargin (Tg)±IL-22 or ER stress-inducing cytokines±IL-22 and then cultured for another 18 hours before assessing glucose-stimulated insulin secretion as follows: islets were cultured consecutively for 30 min each with 2.8 mM glucose, 20 mM glucose, and 20 mM glucose+100 nM GLP-1 and total insulin (B) and proinsulin (C) secretion measured by ELISA.

In healthy murine islets, treatment with tunicamycin, thapsigargin, IL-18, IL-23 and IL-24 induces Xbp1-splicing and Hspa5 mRNA (Grp78, ER chaperone upregulated during ER stress) (FIG. 6A). These ER stress agents decreased insulin secretion by islets in response to both glucose and glucose plus GLP-1, while increasing inappropriate secretion of proinsulin (FIGS. 6B,C). Co-treatment with IL-22 suppresses the acute islet oxidative stress-driven ER stress and restores appropriate glucose and glucose plus GLP-1 stimulated insulin secretion (FIGS. 6B,C).

High Fat Diet Induced Obesity (HFDIO)

Figure 7:
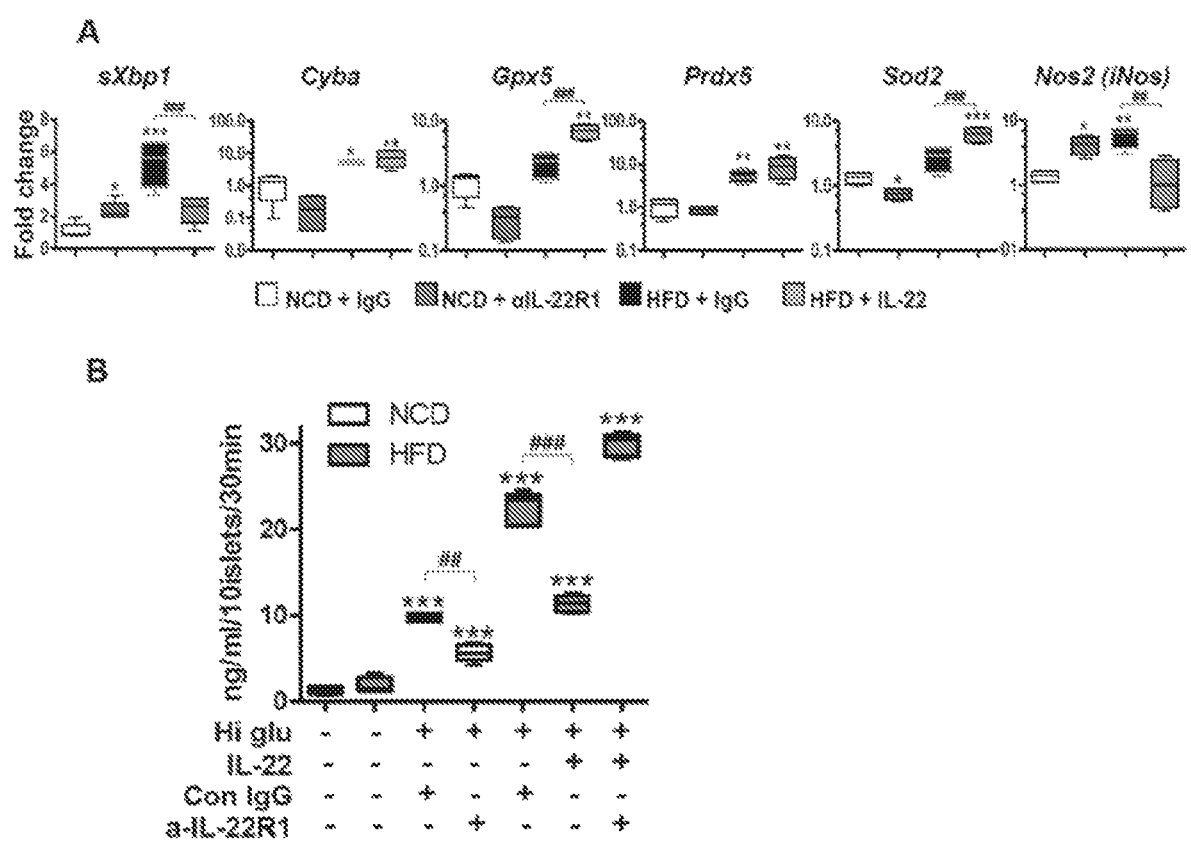
FIG. 7: Endogenous and exogenous IL-22 affects healthy islets and islets from obese mice. (A) mRNA expression of oxidative and ER stress genes in healthy islets cultured for 24 hours in control (IgG) or αIL-22R1 antibodies, and in islets from mice on a high fat diet (HFD), after culturing for 24 hours in control IgG or IL-22. (B) Total insulin secretion in 30 min by healthy and HFD islets cultured±glucose ("Hi glu") following culture in glucose±IL-22, IgG or αIL-22R1.

In healthy murine islets ex vivo treatment with IL-22R1 blocking antibody increased ER stress, decreased anti-oxidant gene expression, increased Nos2 (FIG. 7A), and decreased GSIS (FIG. 7B). Islets from mice with high fat diet-induced obesity (HFDIO) exhibited ER stress and upregulation of anti-oxidant genes decreased Nos2 (FIG. 7A). Culture with IL-22 reduced ER stress, increased anti-oxidant gene expression and decreased Nos2 (FIG. 7A).

In contrast to acute ER stress, HFDIO islets, which are adapted to chronic ER stress, showed increased GSIS. Insulin hyper-secretion was accentuated by culture in IL-22R1 antibody, and returned to levels in non-obese islets after culture in IL-22 (FIG. 7B). HFDIO islets, but not healthy islets secreted proinsulin, even in low glucose conditions, and proinsulin secretion ceased after IL-22 treatment (FIG. 7B).

These experiments demonstrate that IL-22-IL-22R1 signaling is required for normal islet function, and that exogenous IL-22 suppresses chronic ER stress in HFDIO islets, reducing GSIS to normal levels while blocking proinsulin release.

Materials and Methods

Acute ER-Stress Experiments

Healthy islets were cultured with 10 μg/mL tunicamycin or 5 μM thapsigargin±IL-22 for 6 hours. Alternatively the islets were cultured in the presence of ER stress-inducing cytokines±IL-22 for 24 hours. The cultures were then cultured consecutively for 30 minutes in 2.8 mM glucose, 20 mM glucose, or a combination of 20 mM glucose and 100 nM GLP-1.

High Fat Diet Induced Obesity (HFDIO) Experiments

All mice were housed in sterilized, filter-topped cages in a conventional clean facility. Six to eight week old C57BL/6 male mice were fed ad libitum on a high fat diet containing 46% of available energy as saturated fat, 34% carbohydrate, 20% protein (Speciality feeds, SF04-027). Or on normal chow containing less than 10% saturated fat (GOLDMIX, 126575). Cages of mice were randomly allocated to the experimental groups by random draw. Investigators were not blinded to treatment by there were no subjective assessments made.

Insulin and Proinsulin Measurements

Total insulin and proinsulin were measured in supernatant from islet cultures or in serum from mice using commercially obtained ELISA kits from MILLIPORE and MERCODIA, respectively. The molar insulin concentration was determined by subtracting the molar proinsulin concentration from molar total insulin, and then the serum proinsulin:insulin ratio was calculated.

Example 4

ER Stress Modulating Cytokines in Diabetic Pancreatic B-Cells

Figure 8:
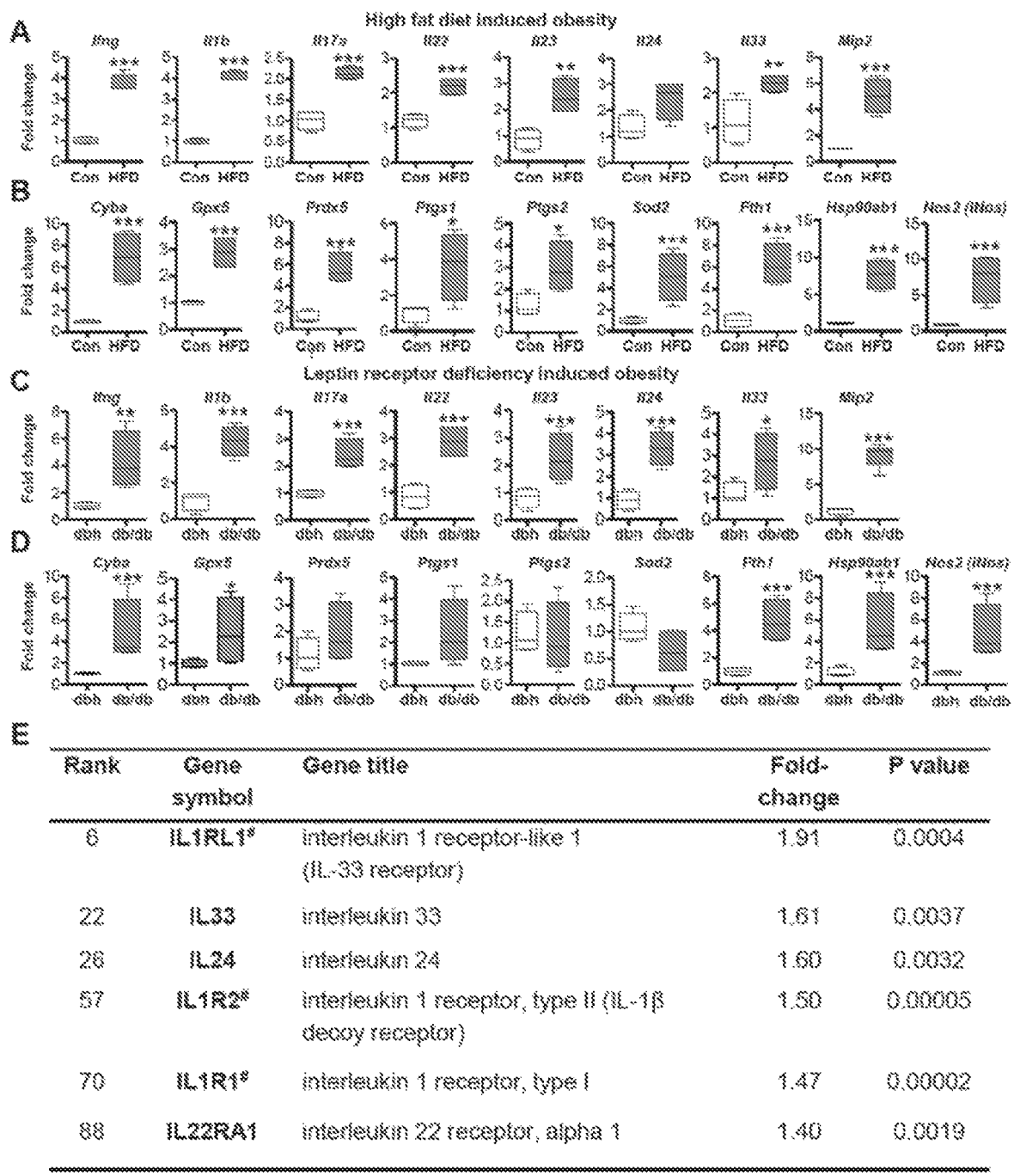
FIG. 8: Inflammation and oxidative stress gene expression in murine obesity and diabetes. Cytokine and chemokine gene (A, C) and oxidative stress regulatory gene (B, D) mRNA expression in islets from mice fed normal chow (Con) or a high fat diet (HFD) (A, B), and leptin receptor deficient (db/db) vs heterozygous (dbh) littermates (C, D). (E) Cytokine and cytokine receptor genes relevant to oxidative and ER stress within the 100 most highly upregulated genes (ranking shown) in a study of human type 2 diabetes islets versus healthy islets.

Although the cytokines found to be the most potent β-cell ER stressors, IL-23, IL-24 and IL-33, have not previously been implicated in T2D pathogenesis, their mRNA were significantly increased in pancreatic β-cells from mice with HFDIO (FIG. 8A). Similarly, this was also the case in β-cells harvested from mice with diabetes due to leptin receptor deficiency (FIG. 8C). The IL-22-regulated pro-oxidant genes and anti-oxidant genes were increased in β-cells from both murine models indicating oxidative stress and a consequent anti-oxidant response (FIGS. 8B,D).

Analysis of a large transcriptome study comparing human healthy islets with those from a patient with type 2 diabetes revealed that IL-24 and IL-33 are the most highly upregulated ER stress-modulating cytokine genes in human type 2 diabetes. This demonstrates the clinical relevance of the identified cytokines (Table 5).

TABLE 5

| Rank | Gene symbol | Gene title | Fold-change | P-value |
|---|---|---|---|---|
| 6 | IL1RL[#]1 | Interleukin 1 receptor-like 1 (IL-33 receptor) | 1.91 | 0.0004 |
| 22 | IL33 | Interleukin 33 | 1.61 | 0.0037 |
| 26 | IL24 | Interleukin 24 | 1.60 | 0.0032 |
| 57 | IL1R2[#] | Interleukin 1 receptor, type II (IL-1β decoy receptor) | 1.50 | 0.00005 |
| 70 | IL1R1[#] | Interleukin 1 receptor, type 1 | 1.47 | 0.00002 |
| 88 | IL22RA1 | Interleukin 22 receptor, alpha 1 | 1.40 | 0.0019 |

Data extracted from NCBI GEO Accession No. GSE41762; P-values are from t-tests, and are non-adjusted;
[#]IL1RL1, IL1R2 and IL1R1 are in a gene cluster on chromosome 2q12.

Materials and Methods

Leptin Deficiency Model of Diabetes

Twenty-week old male diabetic db/db C57BL/KsJ (Lepr$^{+/+}$) and non-diabetic db/h C57BL/KsJ (Lepr$^{+/-}$) mice were sacrificed and blood was collected via cardiac puncture. Db/db mice develop severe metabolic defects in the context of type 2 diabetes (hypertension, hyperlipidemia, obesity, insulin abnormalities). A small number of animals that died for reasons unrelated to the treatment in these long-term experiments were excluded from the analysis. All experiments were approved by the University of Queensland Animal Experimentation Ethics Committee or the Alfred Medical Research and Education Precinct Animal Ethics Committee, and conducted in accordance with guidelines set out by the National Health and Medical Research Council of Australia.

Example 5

Figure 9A:
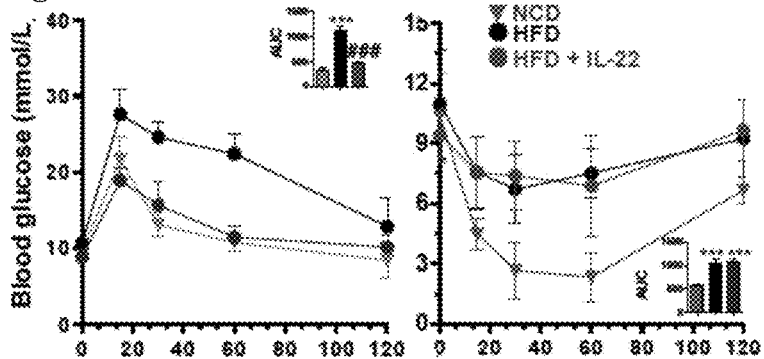
Figure 9B:
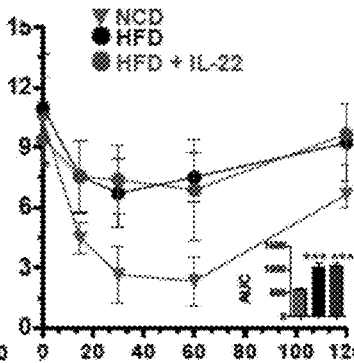
Figure 9C:
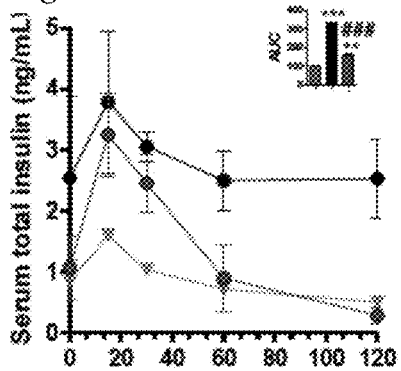
Figure 9D:
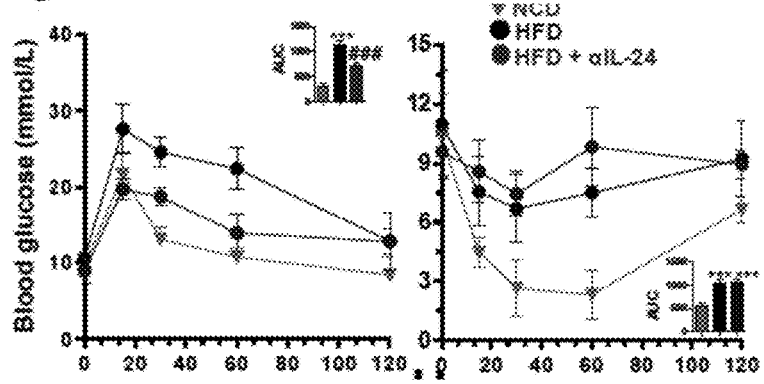
Figure 9E:
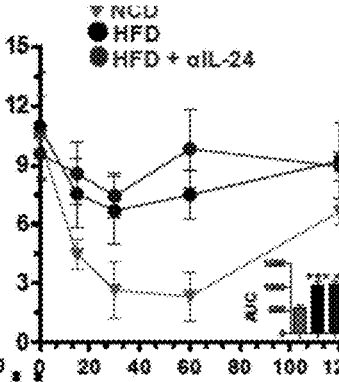
Figure 9F:
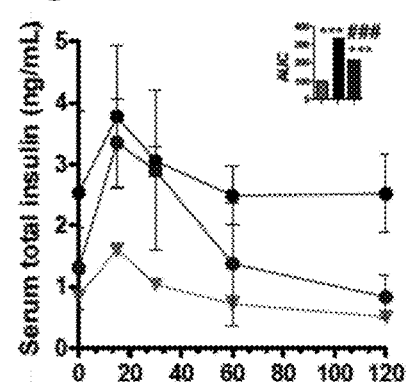
Figure 9G:
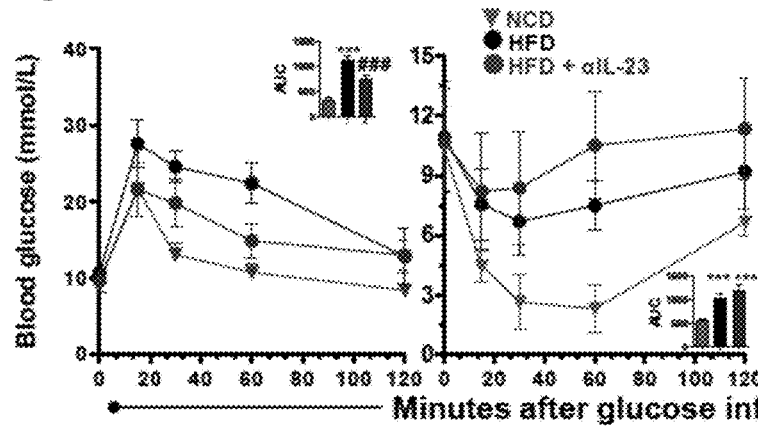
Figure 9H:
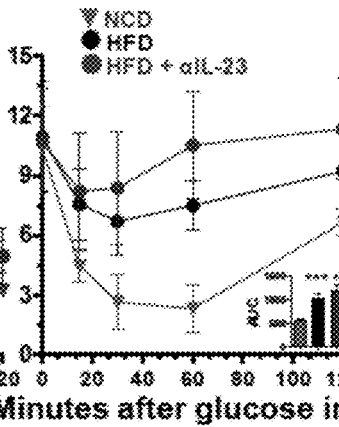
Figure 9I:
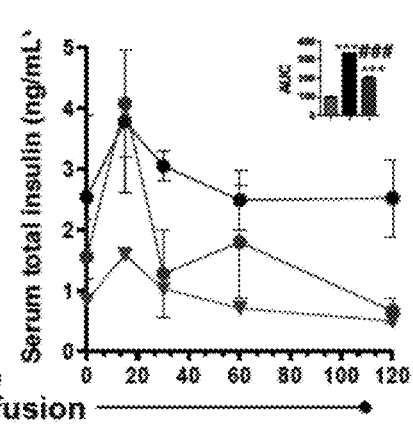

Neutralization of ER Stress-Inducing Cytokines or Administration of IL-22 Improves Glycemic Control in Obese Mice The in vitro findings suggested that neutralizing the ER stressor cytokines, or administering IL-22, would reduce pancreatic oxidative and ER stress and improve insulin biosynthesis in obesity. In mice fed a HFD for 15 weeks, two weeks of IL-22 administration, or antibody neutralization of either IL-23 or IL-24, substantially reversed glucose intolerance as measured by an i.p. glucose tolerance test (IP-GTT), with IL-22 the most efficacious (FIG. 9A,D,G). The area under the curve (AUC glucose) for the IPGTT was 2.5-fold higher in mice with HFDIO and the increase was reduced by 42, 50 and 82% with anti-IL-23, anti-IL-24 and IL-22 treatment, respectively. Improved glucose tolerance could occur via improved insulin sensitivity. However, insulin tolerance tests (ITTs) demonstrated that treated mice had unresolved insulin resistance (FIGS. 9B, E, H). Fasting serum total insulin concentrations were 2.8-fold higher in HFDIO compared to non-obese mice (FIGS. 9C, F, I and Table 6). All three therapies decreased fasted total insulin concentrations and AUC insulin, however AUCs were greater than in mice fed normal chow, consistent with requiring more insulin to deal with persisting insulin resistance (FIGS. 9C, F, I). Anti-IL-23 and, more effectively, IL-22 decreased the fasted serum proinsulin:insulin ratio (FIG. 9J), with IL-22 reducing serum proinsulin by 92% (Table 6).

TABLE 6

| | Fasting Concentrations | | | |
|---|---|---|---|---|
| | Body weight (% original) | Blood glucose (mmoL/L) | Serum insulin concentration (ng/mL) | Serum proinsulin concentration (pmol/L) |
| HFDIO Experiment 1 | | | | |
| 10 weeks on NCD | 113 ± 4 | 7.6 ± 1.8 | 0.7 ± 0.01 | Not determined |
| 16 weeks on NCD | 120 ± 9 | 9.6 ± 0.9 | 0.9 ± 0.1 | Not detectable |
| 16 weeks on NCD + IL-22 | 118 ± 3 | 8.9 ± 0.8 | 0.5 ± 0.1 | Not detectable |
| 16 weeks on NCD + αIL-23 | 117 ± 3 | 10.1 ± 0.7 | 0.4 ± 0.2 | Not detectable |
| 16 weeks on NCD + αIL-24 | 115 ± 3 | 9.5 ± 1.9 | 0.4 ± 0.3 | Not detectable |

TABLE 6-continued

| | Fasting Concentrations | | | |
|---|---|---|---|---|
| | Body weight (% original) | Blood glucose (mmoL/L) | Serum insulin concentration (ng/mL) | Serum proinsulin concentration (pmol/L) |
| 10 weeks on HFD | 134 ± 8 | 10.5 ± 1.5 | 2.0 ± 1.2 | Not determined |
| 16 weeks on HFD | 147 ± 8 | 10.6 ± 0.5 | 2.5 ± 1.2 | 73.9 ± 32.9 |
| 16 weeks on HFD + IL-22 | 129 ± 9 | 8.8 ± 0.9 | 1.1 ± 0.5 | 9.5 ± 3.8 |
| 16 weeks on HFD + αIL-23 | 149 ± 7 | 10.7 ± 2.6 | 1.6 ± 0.6 | 22.7 ± 19.6 |
| 16 weeks on HFD + αIL-24 | 148 ± 8 | 9.6 ± 1.2 | 1.3 ± 0.7 | 40.6 ± 18.2 |
| HFDIO Experiment 2 | | | | |
| 22 weeks on NCD | 140.6 ± 6 | 1.03 ± 0.6 | 0.9 ± 0.1 | 3.3 ± 0.6 |
| 22 weeks on HFD | 225 ± 10 | 14.1 ± 1.3 | 3.1 ± 1.0 | 152.0 ± 41.8 |
| 22 weeks on HFD + IL-22 (20 ng/g) | 188 ± 13 | 11.3 ± 0.5 | 0.7 ± 0.4 | 14.1 ± 2.9 |
| 22 weeks on HFD + IL-22 (100 ng/g) | 189 ± 17 | 10.6 ± 1.3 | 0.5 ± 0.3 | 4.7 ± 1.8 |

Figure 10:
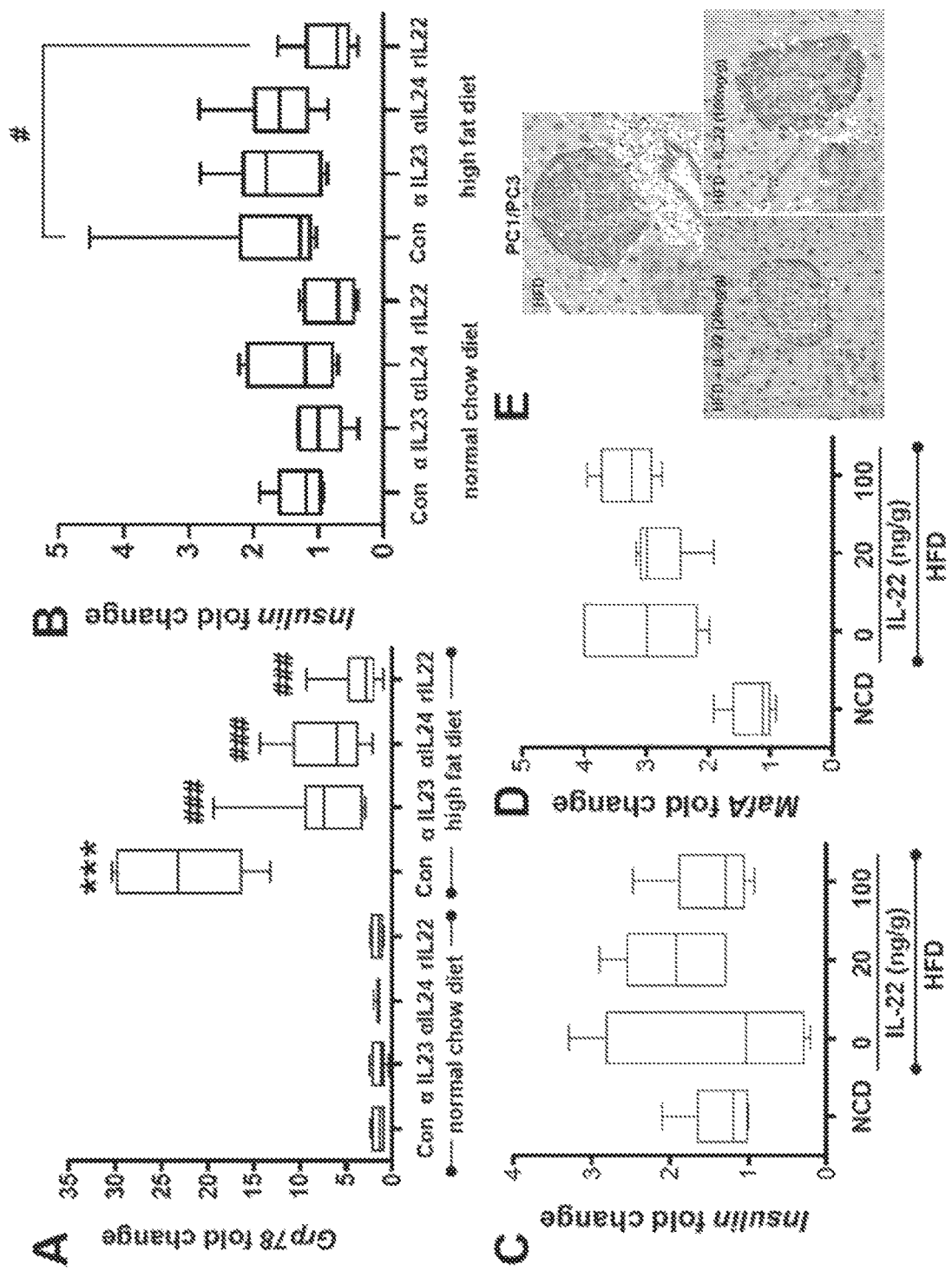
FIG. 10: Neutralizing ER stress inducing cytokines or treating with IL-22 reduces total pancreatic ER stress but does not effect insulin gene expression in HFDIO. (A, B) Mice were fed a high fat diet or normal chow for 16 weeks and treated for the last 3 weeks with anti-IL-23, anti-IL-24, or IL-22 or an irrelevant control antibody (Con) (as described for FIG. 9). Pancreatic ER stress assessed by measurement of Hspa5 (Grp78) (A) and insulin (Ins2) (B) gene expression assessed by qRT-PCR after 3 weeks treatment. (C-E) Mice were fed a HFD or NCD for 22 weeks and treated for the last 30 days with IL-22 at a concentration of either 20 or 100 ng/g (as described in FIG. 5: HFDIO Experiment 2). Insulin (Ins2) (C) and MafA (D) mRNA expression assessed in islets from control and treated mice. (E) Similar to insulin mRNA levels, no changes were observed in the prohormone convertase PC1 (PC3) in the HFD mice treated with IL-22. (A-D) Normalization against the housekeeping gene Gapdh, and expression as fold difference to the untreated normal chow control mice.
Figure 11:
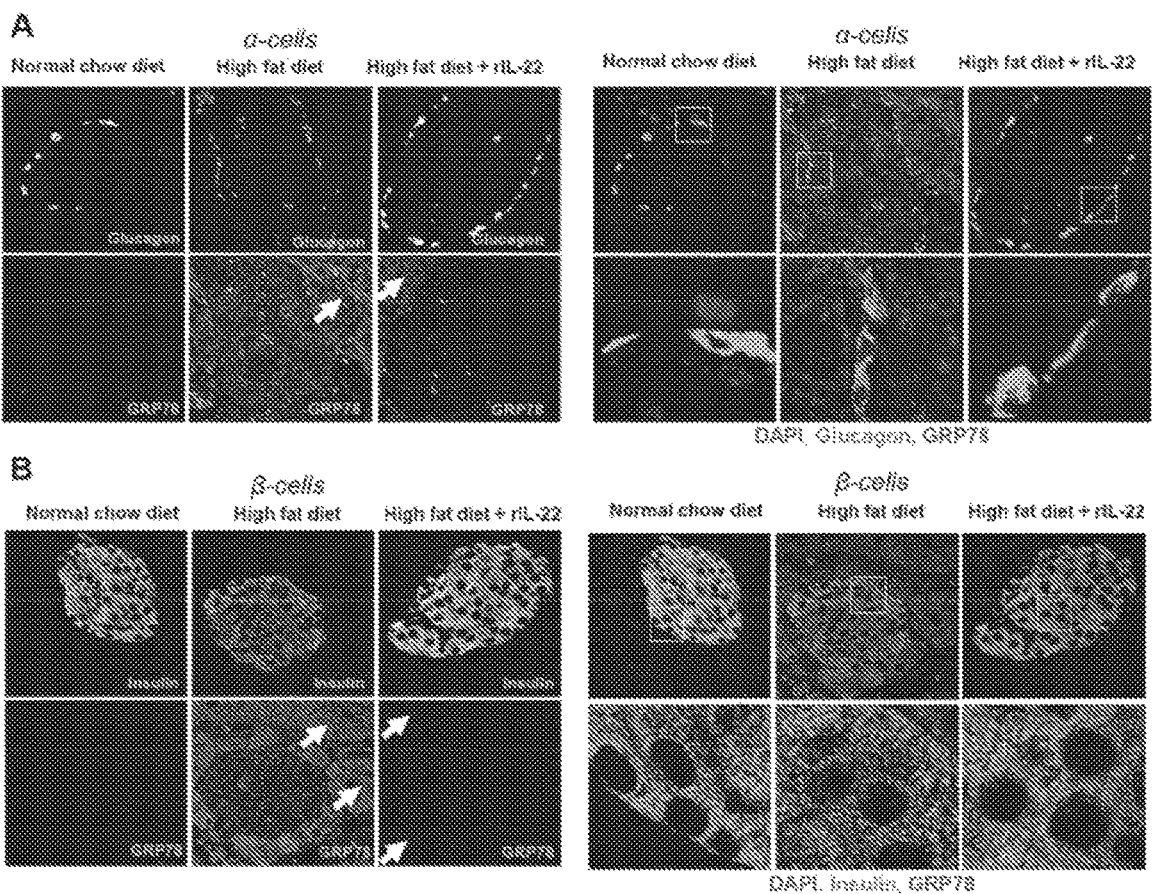
FIG. 11: Assessment of ER stress in pancreatic α- and β-cells in mice with HFDIO with and without treatment with IL-22. Mice were fed a high fat diet for 16 weeks and treated for the last 3 weeks with anti-IL-23, anti-IL-24 or IL-22 (as per FIG. 9) legend. Paraffin sections of pancreata were prepared and co-stained with antibodies against the ER stress marker Grp78, and the α-cell marker glucagon (A) or the β-cell marker insulin (B). Individual single color low power images are shown at the left, and dual color low and high power images are shown at the right. Quantification of Grp78 and insulin in β-cells is shown in FIG. 9. White arrows highlight the acinar cells surrounding the islets.
Figure 12:
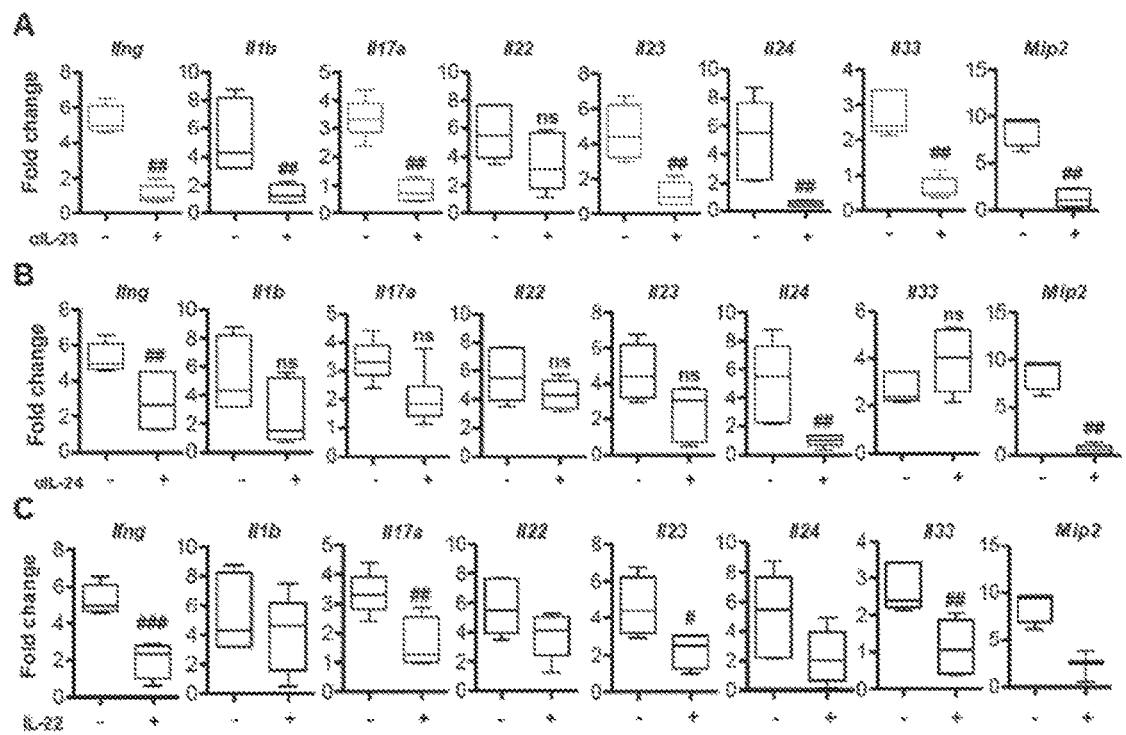
FIG. 12: Neutralizing ER stress inducing cytokines or treating with IL-22 reduces total pancreatic inflammation in HFDIO. In HFDIO Experiment 1 mice were fed a high fat diet for 16 weeks and treated for the last 3 weeks with anti-IL-23 (A), anti-IL-24 (B), or IL-22 (C) or an irrelevant control antibody (as per FIG. 9). Pancreatic cytokine gene expression was assessed using qRT-PCR with normalization against the housekeeping gene Gapdh, and expression as fold difference to the untreated HFDIO mice.

Improvements in glycemic control were paralleled by decreased total pancreatic ER stress (FIGS. 9K and 10A). Immunostaining revealed that Grp78, which accumulates with misfolded proteins, was 11.2-fold higher in the β-cell region of HFDIO islets, and reduced by 75% after IL-22 treatment (FIG. 9L and FIG. 11). β-cell insulin stores decreased by 53% in HFDIO islets, and returned to levels in non-obese mice after IL-22 treatment (FIG. 9L); whereas proinsulin increased by 10.4-fold in HFDIO, and decreased by 64% after IL-22 treatment (FIG. 9L and FIG. 11). There was little change in the MafA transcription factor, which drives β-cell secretory gene expression or insulin (In2) mRNA expression in HFDIO or with treatment (FIG. 10B-D). Despite the proinsulin accumulation there was no change in expression of the prohormone convertase that processes proinsulin into insulin (FIG. 10E). However, pancreatic inflammation was reduced by the cytokine neutralization and IL-22 treatments (FIG. 12).

Figure 13:
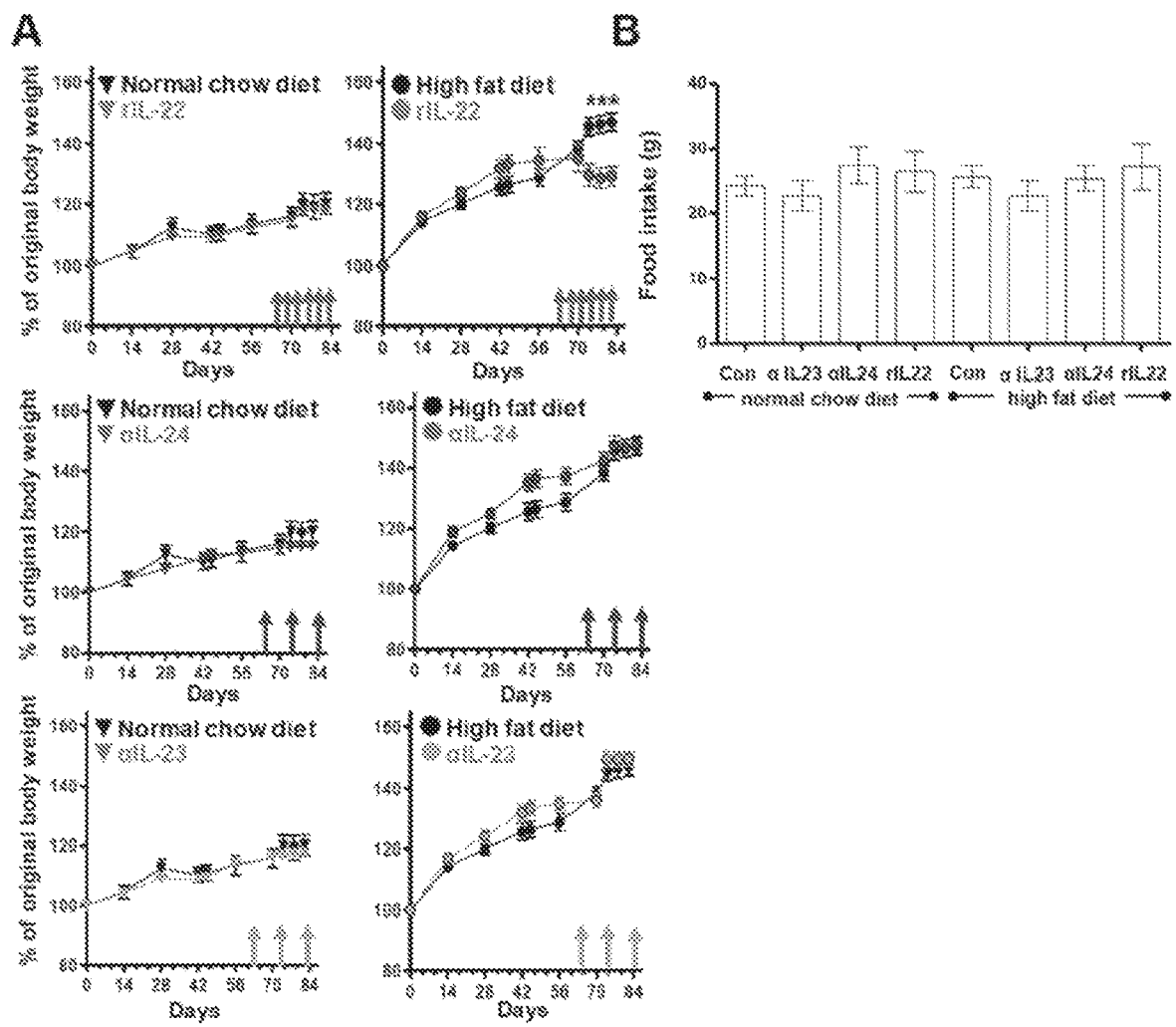
FIG. 13: Altered food consumption does not explain loss of body weight in IL-22-treated HFDIO mice. HFDIO experiment 1 as described for FIG. 9. (A) Body weight changes in HFDIO experiment 1. (B) Results are presented as food consumed per mouse per week. Food consumption in the last 2 weeks of treatment during experiment 1. Mean±SEM.
Figure 14:
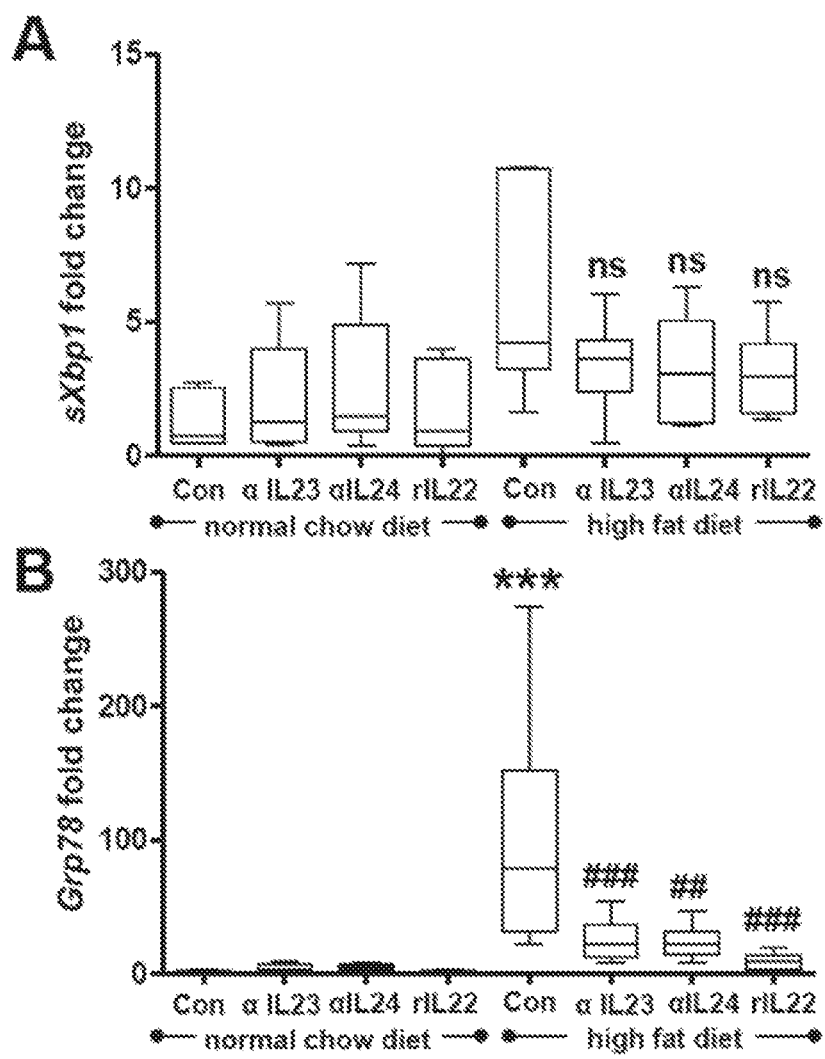
FIG. 14: Neutralizing ER stress inducing cytokines or treating with IL-22 reduces hepatic upregulation of Grp78 in HFDIO. As described for HFDIO experiment 1 mice were fed a high fat diet or normal chow for 16 weeks and treated for the last 3 weeks with anti-IL-23, anti-IL-24, or IL-22 or an irrelevant control antibody (Con) (as per FIG. 9). Hepatic ER stress assessed by measurement of spliced-Xbp1 (A) and Hspa5 (Grp78) (B) mRNA by qRT-PCR after 3 weeks treatment. Normalization against the housekeeping gene Gapdh, and expression as fold difference to the untreated normal chow control mice.

Interestingly, mice treated with IL-22, but not mice treated with IL-23 or IL-24 neutralizing antibodies, progressively lost weight during treatment without changing food consumption (FIG. 13). Treated normal chow fed mice did not show any significant change in weight or metabolic measurements, although there were trends toward lower fasted blood glucose and insulin concentrations (Table 2), and improved glucose tolerance with IL-22 (FIG. 13). IL-22 also affects hepatocytes, and hepatic ER stress occurs in obesity. Whereas hepatic Xbp1-splicing was only slightly increased in HFDIO, Hspa5 was highly upregulated and decreased substantially after treatment with anti-IL-23, and anti-IL-24 and IL-22 (FIG. 14).

Materials and Methods

Histology, Immunofluorescence Microscopy and Histological Quantification

HFDIO Experiment 1:

From β-16 weeks of the diet, mice were treated with 20 ng/g i.p. recombinant murine IL-22 twice weekly (R&D SYSTEMS), 3 μg/g anti-IL-23 weekly (ELI-LILLY), 0.1 mg/mouse anti-IL-24 weekly (PROTEIN TECH), or 0.5 mg/mouse irrelevant isotype control antibody, sacrificed and sampled.

HFDIO Experiment 2:

From 18-22 weeks of diet, mice were treated (for 30 days) with 20 or 100 ng/g i.p. recombinant murine IL-22 twice weekly (R&D SYSTEMS) or 0.1 mg/mouse irrelevant isotype control antibody, sacrificed and sampled.

Fasted i.p. glucose tolerance tests (2 g/kg glucose) and insulin tolerance tests (0.25 U/kg insulin; Humalog, Lilly) were performed at the times indicated in the Figure Legends.

Pancreatic tissue was fixed in 10% neutral buffered formalin and processed using standard histological techniques. Standard immunohistochemical and immunofluorescent staining methods were used to determine the presence of Grp78, insulin, glucagon, IL-22R1, proinsulin and ATF6-GFP.

The area in pixels/mm$^2$ was determined for Grp78 and insulin (immunofluorescence) and proinsulin (immunohistochemisty) in the core of β-cell rich area of 3-4 islets per mouse (n=6-10 mice) using IMAGEJ software version 1.45s. Live cell imagine in MIN6N8 cells was carries out at 37° C. in 5% $CO_2$ in a chamber using an OLYMPUS XCELLENCE RT microscope.

Example 6

Figure 15:
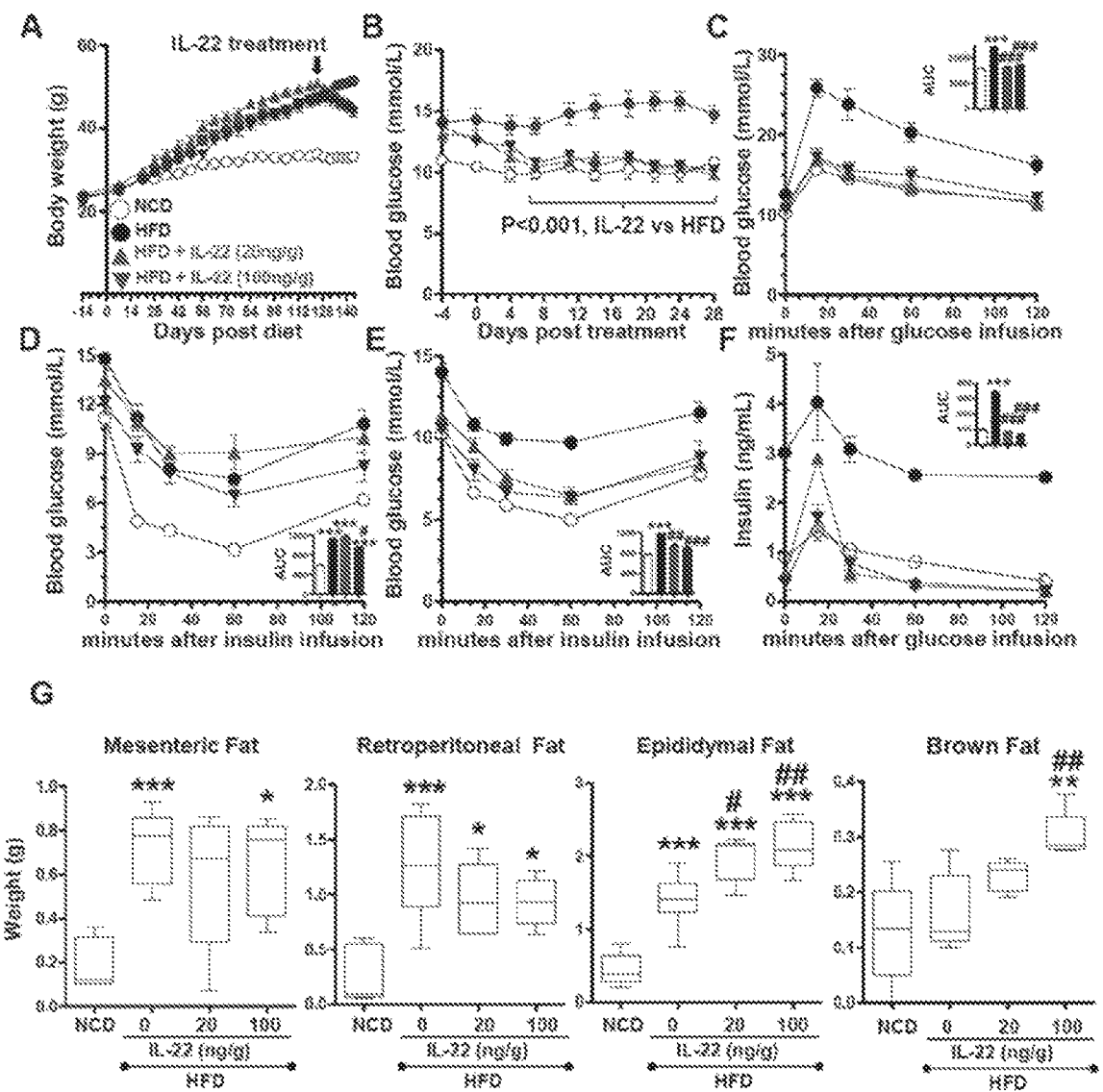
FIG. 15: Extended IL-22 treatment restores both glucose tolerance and insulin sensitivity in HFDIO. Mice were fed a high fat diet (HFD) or normal chow diet (NCD) for 22 weeks and treated for the last 30 days with 20 or 100 ng/g IL-22 twice weekly. NCD and HFD control mice received an irrelevant IgG control antibody. (A) Body weight. (B) Random fed blood glucose concentrations during treatment. (C-E) Blood glucose during a fasted i.p. glucose tolerance test on day 25 (C), and insulin tolerance tests on day 16 (D) and 29 (E) of treatment. AUC=area under curve. (F) Serum total insulin during fasted i.p. glucose tolerance test on day 25. (G) Redistribution of fat in IL-22-treated obese mice.

Prolonged IL-22 Therapy Restores Insulin Sensitivity after Restitution of Glycemic Control To assess longer and higher dose therapy in more advanced disease mice were administered IL-22 at 20 ng/g (the first experiment dose) or 100 ng/g for the last 30 days of a 22-week HFD. Body weight progressively decreased beginning one week into IL-22 treatment (FIG. 15A), accompanied by changes in distribution of adipose tissue with increased epididymal and brown fat (FIG. 15G). Demonstrating rapid restoration of glycemic control, random fed blood glucose concentration decreased to levels seen in normal chow fed mice within 7 days with both doses of IL-22 (FIG. 15B). An IPGTT on day 25 of therapy showed glycemic control indistinguishable from control non-obese mice (FIG. 15C). At day 16 of therapy, an ITT showed no or modest improvement in insulin resistance (FIG. 15D), however, by day 29 insulin resistance had decreased with both doses of IL-22 (FIG. 15E).

Figure 16:
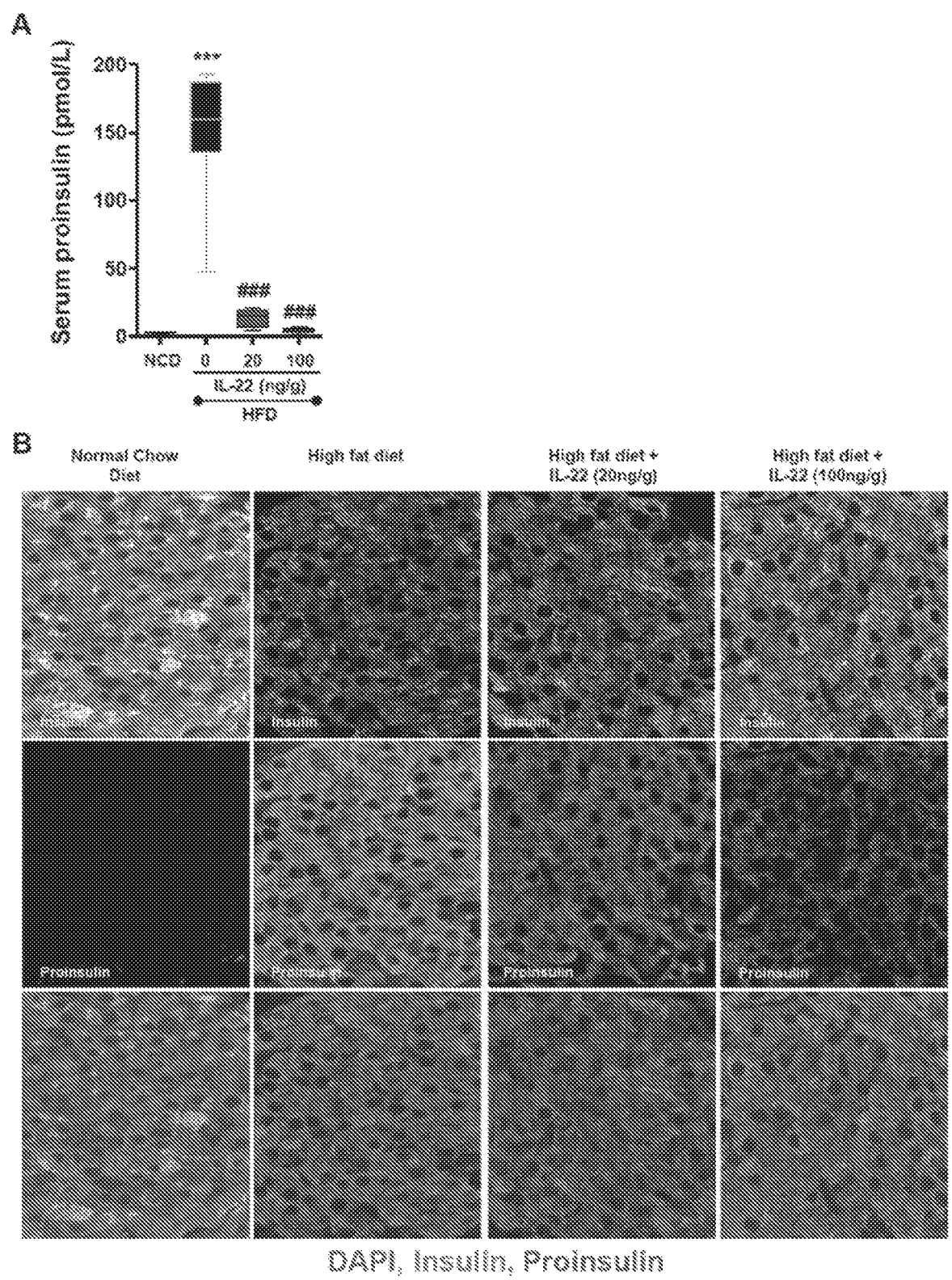
FIG. 16: Extended IL-22 treatment reduces serum proinsulin and islet proinsulin accumulation in HFDIO. Mice were fed a high fat diet (HFD) or normal chow diet (NCD) for 22 weeks and treated for the last 30 days with 20 or 100 ng/g IL-22 twice weekly. NCD and HFD control mice received an irrelevant IgG control antibody. (A) Fasted serum proinsulin at the end of treatment. (B) Co-staining of total insulin (green) and proinsulin (magenta) analyzed by confocal-microscopy. Individual single color images are shown at the top, and dual color images are shown at the bottom. Color reproductions of FIG. 16 are available upon request.

Measurement of serum total insulin during day 25 IPGTT showed complete suppression of fasting hyperinsulinemia and normalization of GSIS (FIG. 15F). These improvements were accompanied by normalization of the serum proinsulin:

insulin ratio, with serum proinsulin decreased 97% by 100 ng/g IL-22 (FIG. 16A, Table 6). The dose dependent improvement in serum proinsulin was mirrored by decreases in proinsulin staining and increases in total insulin staining of islets (FIG. 16B).

Materials and Methods

Experiments were performed as described for previous examples with the intervention being HFDIO Experiment 2.

Example 7

Figure 17:
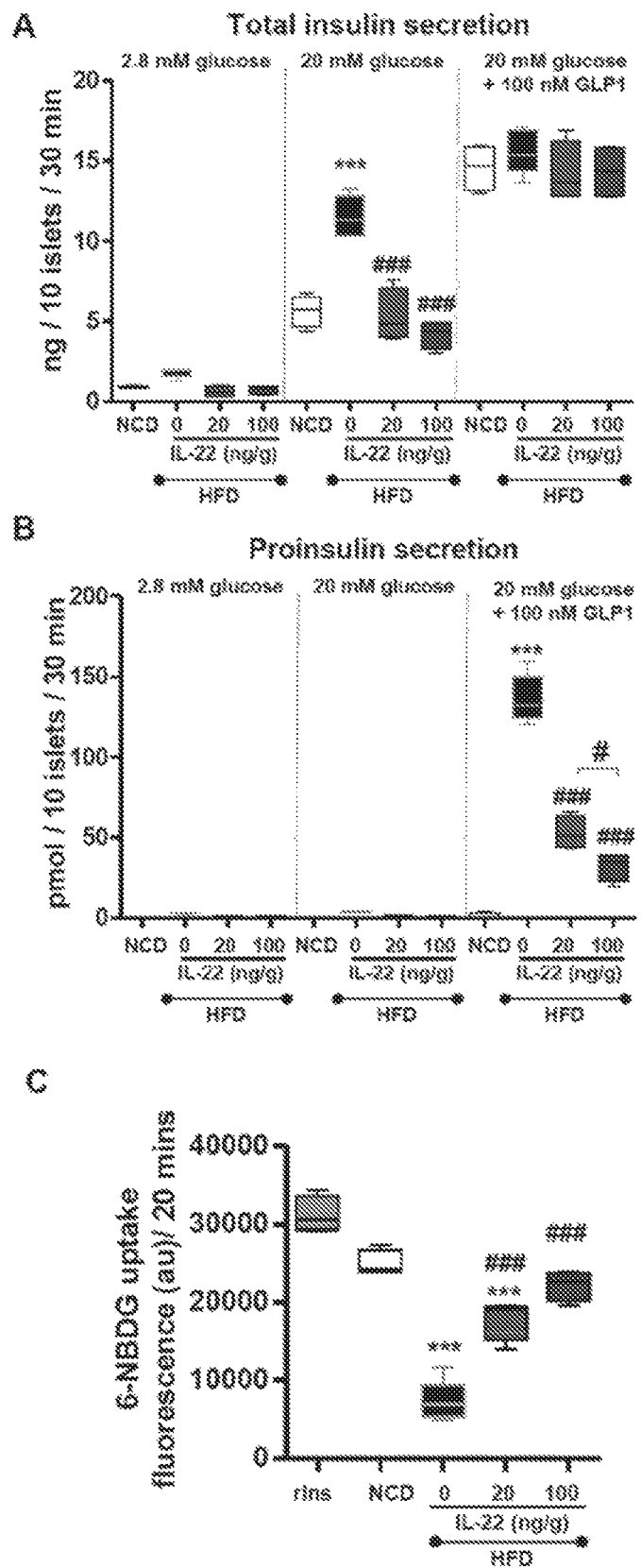
FIG. 17: Extended IL-22 treatment normalizes islet insulin secretion in HFDIO. Mice were fed a high fat diet (HFD) or normal chow diet (NCD) for 22 weeks and treated for the last 30 days with 20 or 100 ng/g IL-22 twice weekly. NCD and HFD control mice received an irrelevant IgG control antibody. (A, B) Total insulin (A) and proinsulin (B) secretion from islets from NCD and HFD control and treated mice on day 30 cultured overnight in 2.8 mM glucose, and cultured consecutively for 30 min each with 2.8 mM glucose, 20 mM glucose, and 20 mM glucose+100 nM GLP-1. (C) Uptake of fluorescent deoxy-glucose (6-NBDG) by 3T3 adipocytes in response to 2 ng/mL of recombinant insulin (rIns) or insulin derived from the glucose plus GLP-1 stimulation of islets shown in (B).

Islets from IL-22 Treated Mice Show Normalized Secretion of High Quality Insulin Ex vivo culture of islets from obese mice treated with IL-22 for 30 days demonstrated correction of insulin hypersecretion in response to glucose (FIG. 17A), replicating the result of ex vivo exposure to IL-22 in HFD islets. When exposed to glucose/GLP-1, equal amounts of total insulin were secreted by HFD, HFD plus IL-22, and non-obese islets (FIG. 17A). However, while no detectable proinsulin was secreted by non-obese islets, the HFD islets secreted proinsulin, and this was reduced in a dose-dependent manner by in vivo treatment with IL-22 (FIG. 17B). Thus, both ex vivo and in vivo treatment with IL-22 reduced total insulin and proinsulin secretion by islets from mice on a HFD, consistent with the amelioration of serum hyperinsulinemia and reduced serum proinsulin observed in vivo.

To assess the functional quality of insulin compared the ability of the insulin secreted by islets in response to glucose/GLP-1 to stimulate uptake of fluorescent deoxyglucose (6-NBDG) by 3T3 cells differentiated into adipocytes. Insulin secreted by HFDIO islets ex vivo showed a 70% reduction in stimulation of adipocyte 6-NBDG uptake compared to insulin secreted by islets from normal chow fed mice. In contrast, there was only a 11% reduction in adipocyte 6-NBDG uptake with insulin secreted by islets from mice treated with 100 ng/g IL-22 (FIG. 17C). Thus, in vivo IL-22 therapy improved the efficacy of secreted insulin.

Materials and Methods

Glucose Uptake Experiments

3T3 cells were differentiated into adipocytes as previously described, and all experiments were carried out on day 8 post differentiation. $1 \times 10^4$ cells were seeded in a black 96-well plate and cultured in serum free 2.8 mM glucose media prior to the addition of insulin. Cells were treated for 1 h with 2 ng/mL recombinant insulin or total insulin from islet secretions at 37° C. as described in figure legends. Subsequently, cells were incubated with 6-(N-(7-nitrobenx-2-oxa-1,3-diazol-4-yl)amino)-6-deoxyglucose (6-NBDG) (MOLECULAR PROBES) for 20 min before cells were washed with PBS and glucose uptake was determined using a POLARstar Omega plate reader.

Example 8

Figure 18:
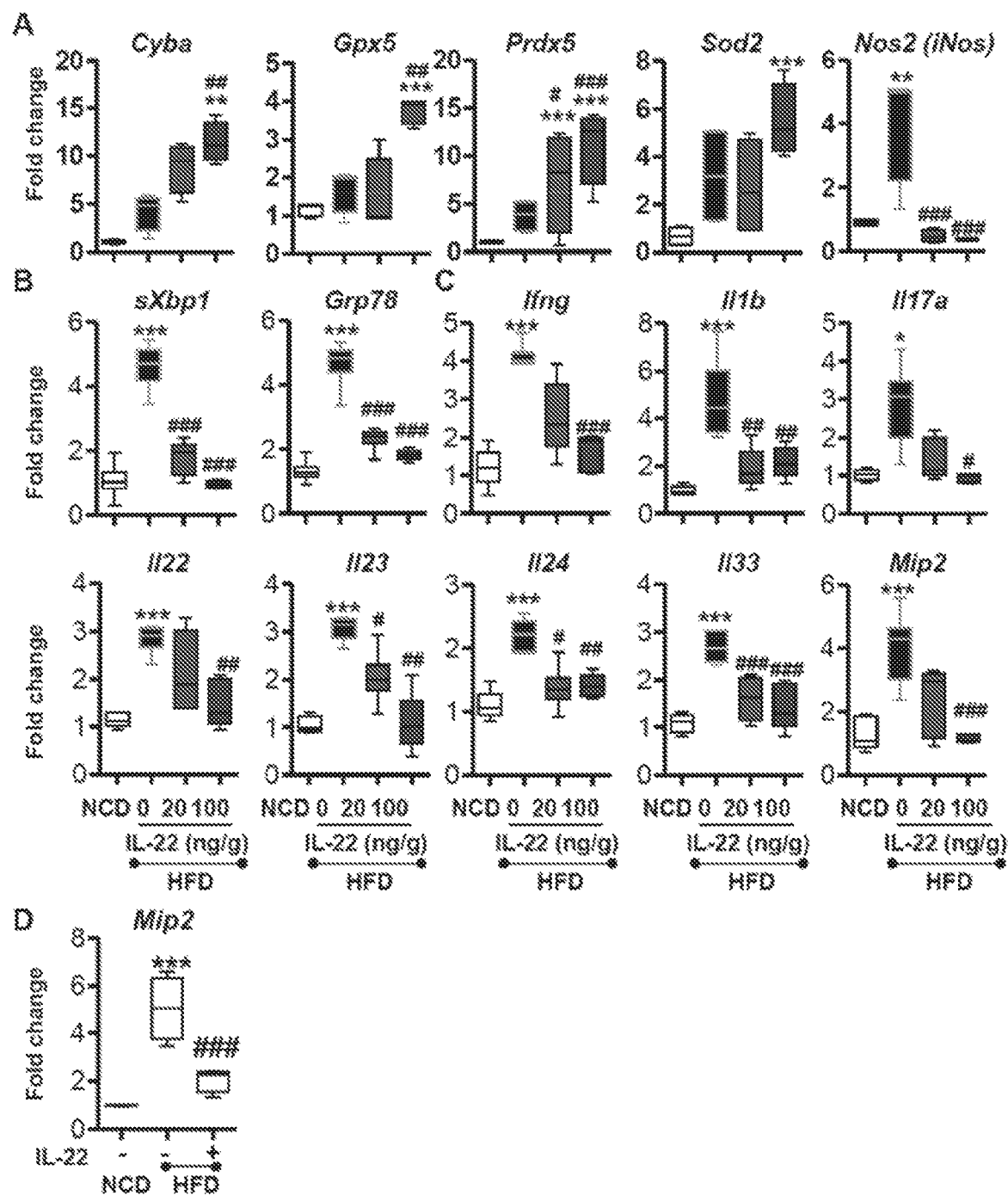
FIG. 18: IL-22 treatment modulates oxidative stress genes and reduces ER stress and inflammation in pancreatic islets. mRNA expression of oxidative stress (A), ER stress (B), and cytokine and chemokine (C) genes in pancreatic islets from mice suffering from HFDIO (as described for FIG. 15). (D) Mip2 mRNA expression in pancreatic islets from mice on a high fat diet (HFD) or normal chow diet (NCD) for 20 weeks cultured for 24 h in 2.8 mM glucose±50 ng/mL IL-22.

Effect of IL-22 Treatment on Expression of Oxidative Stress Regulatory Genes and Reduces Er Stress and Inflammation Islets from mice with HFDIO showed an upregulation of anti-oxidant genes and Nos2, and IL-22 therapy further increased expression of anti-oxidant genes and suppressed Nos2 (FIG. 18A), emulating when β-cells and islets were treated with IL-22 in vitro. ER stress decreased in islets from HFDIO mice treated with both doses of IL-22, with Xbp1 splicing indistinguishable from normal chow islets with 100 ng/g IL-22 (FIG. 18B). Although in the first experiment IL-22 was shown to suppress total pancreatic inflammation, a remaining question was whether IL-22 suppression of ER stress reduced inflammation within islets. Expression of multiple cytokines and chemokines decreased in HFDIO islets from mice treated with IL-22 in vivo, with the higher dose generally more efficacious (FIG. 18C). MIP2α mRNA reduced substantially in HFDIO islets cultured in IL-22 (FIG. 18D), paralleling decreased ER stress (FIG. 18D). These observations are consistent with IL-22 therapy in obese mice disrupting the cycle of islet ER stress and inflammation.

Example 9

Effect of IL-22 Treatment on Oxidative Stress in Human Islets Cultured In Vitro

Based of these results, it is hypothesized that the inflammatory cytokines that induce ER stress in secretory cells do so as part of rapid immune responses to viral infection. Acute ER stress induces a PERK-mediated block in protein translation, which would effectively reduce viral replication. Accordingly, as IL-22 prevents cytokine induced oxidative and ER stress in secretory cells, including in primary human bronchial epithelial cells, it is hypothesized that exogenously administered IL-22 would increase viral replication in respiratory epithelial cells.

To test this hypothesis mice were infected with pneumovirus (PVM), a murine respiratory virus similar to the respiratory syncytial virus (RSV) that infects the human lung. Five-day old neonatal C57BL/6 mice were administered either recombinant mouse IL-22 (rmIL-22) or an irrelevant IgG1 mock treatment. At 7 days of age, mice were infected with 100 PFU of PVM (i.n.) and euthanized on 1, 5 and 6 days post-infection. Sham-infected naïve control mice were sampled on days 1, 5 and 6. Lung tissue was removed, and divided into lobes for histological analysis and mRNA quantification. The experiment was stopped on day 6 as 7/9 mice from the rmIL-22 treatment group died between days 5 and 6 and the remaining 2 exhibited signs of suffering (FIG. 20A). PVM gene expression measured by PCR (to quantify viral numbers) increased 2.2-fold in mice treated with IL-22 at 5 days post infection (FIG. 20B). Consistent with increased viral replication, lung injury was also greater at 5 days post infection in IL-22-treated mice, which also exhibited a lung injury score 1.7 times higher (FIG. 20C). Additionally, there were large areas of leukocyte infiltration in the small airways, most likely neutrophils in the IL-22 treated mice at day 5 post-infection (FIG. 21A). Immunohistochemical detection of PVM in both the control infected mice and the IL-22-treated infected mice showed that PVM was located in epithelial cells, and supported the higher viral titers measured by PCR (FIG. 21B). Thus, systemically administered IL-22 has the potential to exacerbate the severity of some viral infections in humans.

Taken together with the risks associated with the functional activity of IL-22 in tissues other than the pancreas, directly targeting IL-22 to pancreatic β-cells will decrease exposure to IL-22 in the skin, intestine and liver, and therefore lower the risk of adverse effects.

Materials and Methods

Administration Environment During Murine Viral Infection

Five-day old neonatal C57BL/6 mice were administered intraperitoneal (i.p.) injections of either recombinant mouse IL-22 (rmIL-22) (20 ng/g every three days) [R&D Systems, #582-ML/CF], or an irrelevant IgG1 mock treatment control (12.5 µg/mouse, weekly) [Lilly Pharmaceuticals, LSN2404993]. At 7 days of age, isoflurane-anesthetized mice were infected with 100 PFU of PVM (i.n.) and euthanized on 1, 5 and 6 DPI by sodium pentobarbital overdose (N=2-9 mice/group). Mice were euthanized on day 6 instead of day 7 as 7/9 mice from the rmIL-22 treatment group died between days 5 and 6 and the remaining 2 exhibited signs of suffering. Sham-infected controls (naïve control) were sampled on days 1, 5 and 6. Lung tissue was removed, and divided into lobes for immunohistochemistry (left lobe fixed in 10% formalin and embedded in paraffin, superior lobe frozen in OCT (TISSUE TEK)), mRNA quantification (inferior lobe snap frozen) and protein quantification (middle and post-caval lobes snap frozen).

Assessment of Lung Injury and Inflammation

Paraffin embedded left lobes were sectioned onto Superfrost plus slides. Sections were deparaffinized using SolV21C (MURABAN) and hydrated using graded ethanol solutions. Sections were stained to determine lung injury using hematoxylin (SIGMA ALDRICH) and eosin (SIGMA ALDRICH) (H&E) staining and were mounted on coverslips with Pertex (MEDITE). A scoring system for lung inflammation and injury was devised. This scoring system assessed inflammation in the small airspaces, peribronchiolar interstitial, alveolar interstitial and injury in the airway epithelium. The degree of lung injury and inflammation was scored blindly.

Cells infected by PVM were visualized by immunohistochemistry using rabbit anti-mouse PVM antibody (polyclonal at 1:8000) (ALPHA DIAGNOSTIC, PVMNP14-S). Sections were deparaffinized using xylene and hydrated using ethanol. Antigen retrieval was achieved by boiling in citrate buffer (pH 6) for 20 min. Sections were then blocked with 3% $H_2O_2$/PBS and 10% KPL/PBS 0.05% Tween. Primary antibody was incubated in 10% KPL/PBS 0.05% Tween overnight at 4° C., washed, then incubated for 45 min in donkey anti-rabbit IgG 1:200 (JACKSON), horse-radish peroxidase conjugated secondary antibody before reacting with Diaminobenzidine (DAKO) for 3 min. Sections were then counterstained in hematoxylin, dehydrated in a graded ethanol series and mounted onto coverslips with Pertex. PVM infection was quantified by counting number of infected cells in 4-5 bronchioles per mouse and expressed as the number of infected cells per length of bronchiole epithelium. All sections were visualized on a VS120-L100 slide scanner microscope (OLYMPUS) and analyzed using Oly-VIA v2.4 (OLYMPUS) and IMAGEJ v1.45s.

Example 10

Effect of IL-22 Treatment on Oxidative Stress in Human Islets Cultured In Vitro

Figure 22:
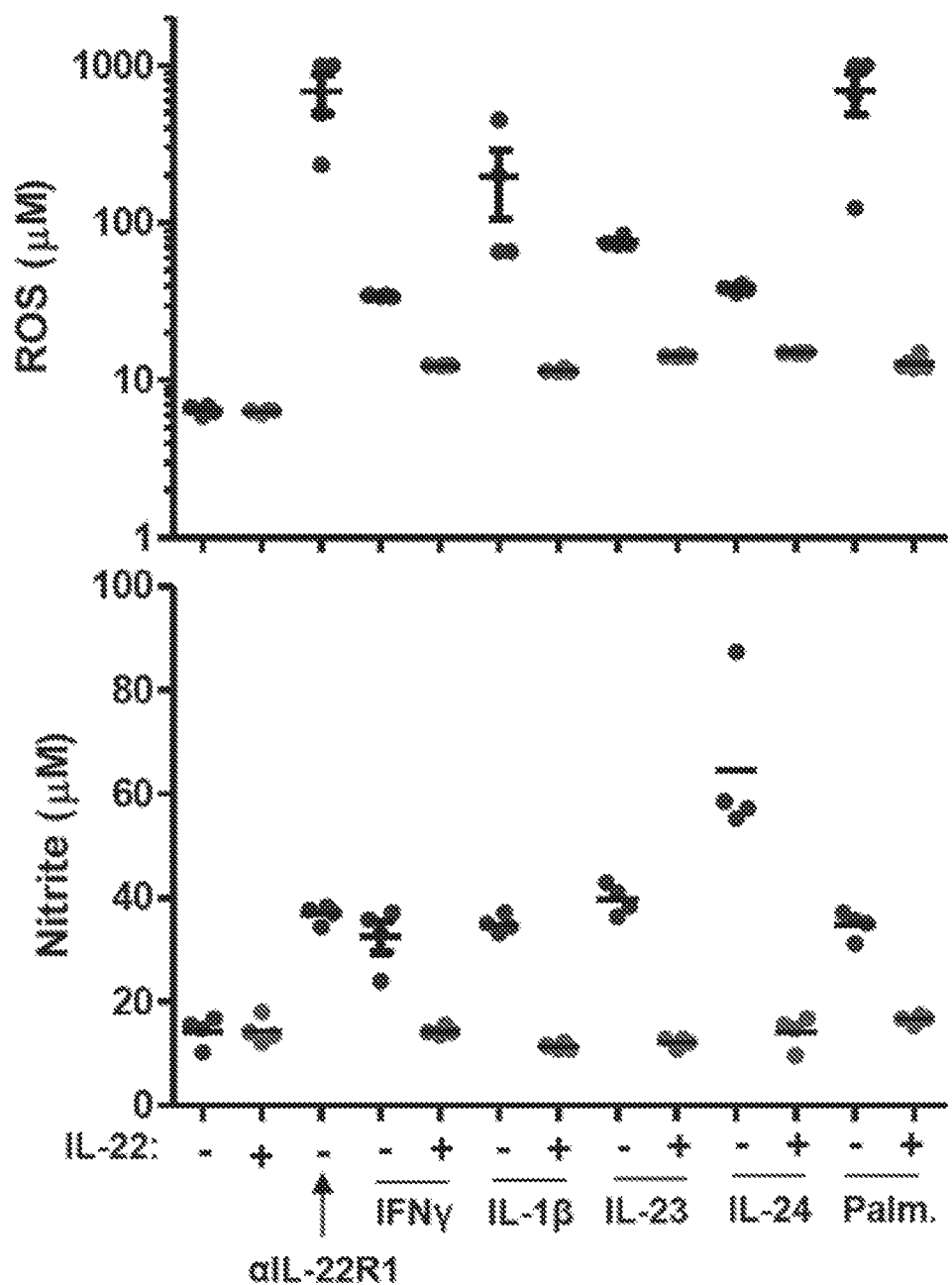
FIG. 22: IL-22 protects human pancreatic islets from the development of oxidative stress. Human pancreatic islets from a single healthy donor were cultured for 2 hours in the presence of 50 ng/mL of IFN-γ, IL-1β, IL-23 or IL-24, or 0.5 mM palmitate, with or without exposure to 50 ng/mL IL-22 beginning 30 min prior to the introduction of the stress inducing cytokines or lipids (n=3 per condition). To test whether endogenous IL-22 affects human islet physiology the islets were treated for 2 hours with an anti-IL-22R1 antibody at 10 µg/mL.

Human islets express high levels of IL-22R1. To demonstrate that the ER stress-inducing or -reducing cytokines would have similar effects on human islets, human pancreatic islets were obtained from a single organ donor and cultured for 2 hours in the presence of ER stress-inducing cytokines or the FFA palmitate, with or without 30 min prior exposure to IL-22. IL-22 protected human islets from the production of ROS and NO induced by IFN-γ, IL-1β, IL-23, IL-24 and palmitate (FIG. 22). In human islets IL-1β induced greater production of ROS than IL-23 and IL-24, whereas IL-24, and to a lesser extent IL-23, induced greater production of NO than IL-1β(FIG. 22). Importantly, just 2 hours exposure to an IL-22 receptor-blocking antibody resulted in high production of both ROS and NO (FIG. 22), demonstrating that endogenous IL-22 signaling is an important component of normal islet physiology in humans, as it was in mice. These results show that the primary effect of IL-22 on mouse β-cells that resulted in the favorable responses to IL-22 therapy in diabetic mice, are replicated in human cells supporting the applicability of IL-22 therapy directed at the pancreas in human diabetes.

Materials and Methods

Human Islet Culture

Human islets were recovered from organ donors and placed into overnight culture in DMEM with 2.8 mM glucose and 10% FCS. Islets were then washed and transferred into serum free DMEM for 6 h prior to experiments to assess induction of oxidative stress. Islets were then cultured for 2-24 hours in the presence of 50 ng/mL of IFNγ, IL-1β, IL-23 or IL-24, or the free fatty acid palmitate at 0.5 mM, with or without exposure to 50 ng/mL IL-22 beginning 30 min prior to the introduction of the stress inducing cytokines or lipids. To test whether endogenous IL-22 affects human islet physiology the islets were treated for 2-24 hours with an anti-IL-22R1 (receptor) antibody at 10 µg/mL. ROS and nitrite were measured using the DCFDA and Greiss assays as described above for murine islets, and quantitative RT-PCR used to assess gene expression.

Summary of the Examples

The experimental evidence presented herein demonstrates IL-22 to be a powerful endogenous paracrine suppressor of oxidative and ER stress in pancreatic islets, and that in obesity-induced hyperglycemia IL-22 therapy restores glucose control by attenuating defects in pancreatic insulin biosynthesis and secretion. IL-22 prevents oxidative and ER stress in pancreatic β-cells, regardless of whether the stress is induced by lipids, inflammatory cytokines or environmental ROS, via STAT1- and STAT3-mediated upregulation of anti-oxidant genes and suppression of oxidative stress-inducing genes. In obese mice IL-22 administration had multiple highly desirable physiological consequences including restoration of glucose tolerance, resolution of hyperinsulinemia and hyperproinsulinemia, restitution of insulin sensitivity, decreased body weight and redistribution of fat to healthy depots. These findings demonstrate that in diabetes, therapy with IL-22 will control hyperglycemia and preserve β-cells, and that targeting IL-22 to a β-cell will provide effective therapy while avoiding possible adverse effects of non-directed systemic IL-22 therapy.

Figure 19:
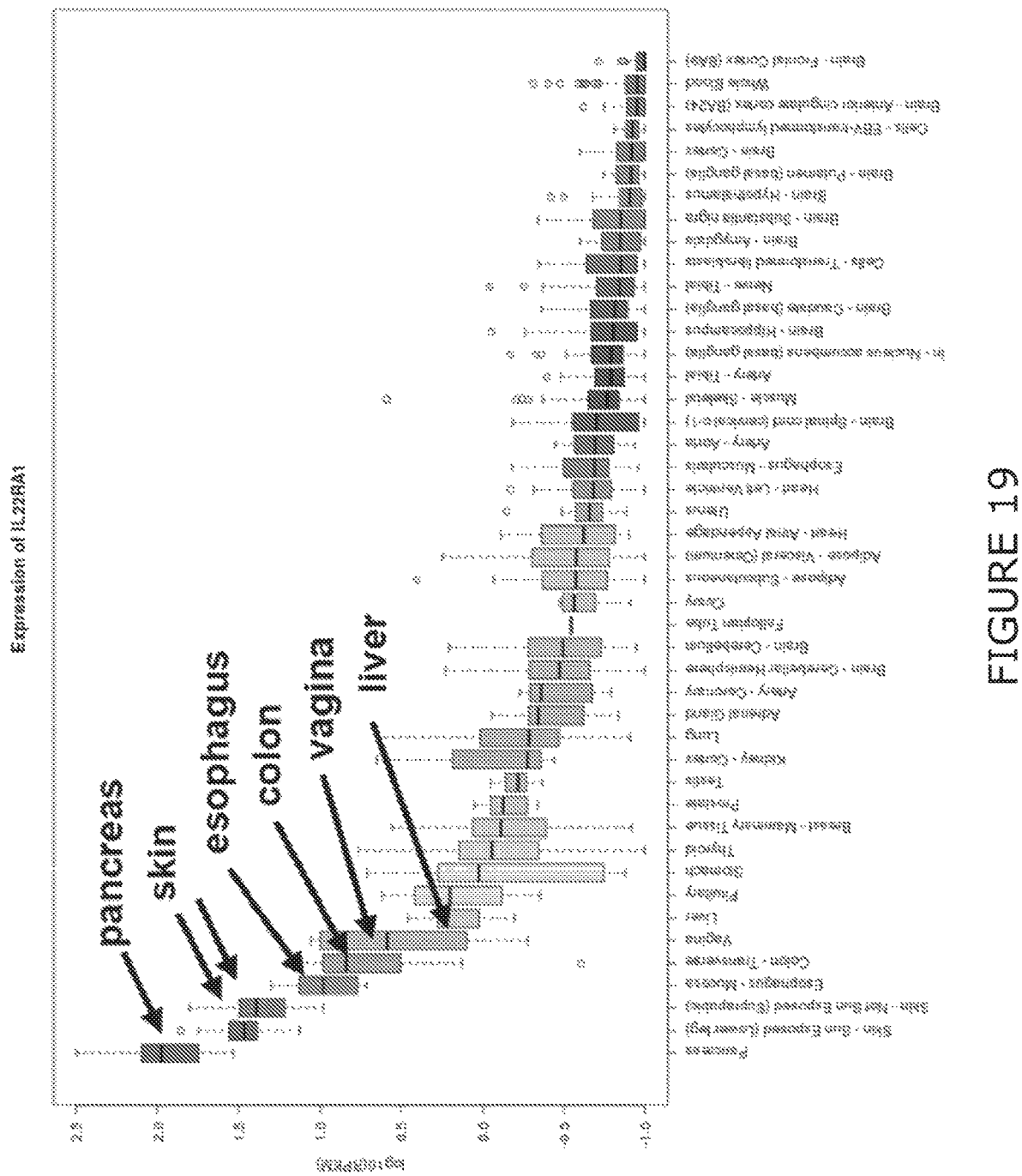
FIG. 19: Expression of IL-22R1 in human tissues. GTEx public domain data (hypertext transfer protocol, world wide web, broadinstitute.org/gtex/) showing human IL22RA1 mRNA expression across a range of tissues, with highest expression in the pancreas (note $\log_{10}$ scale).
Figure 20:
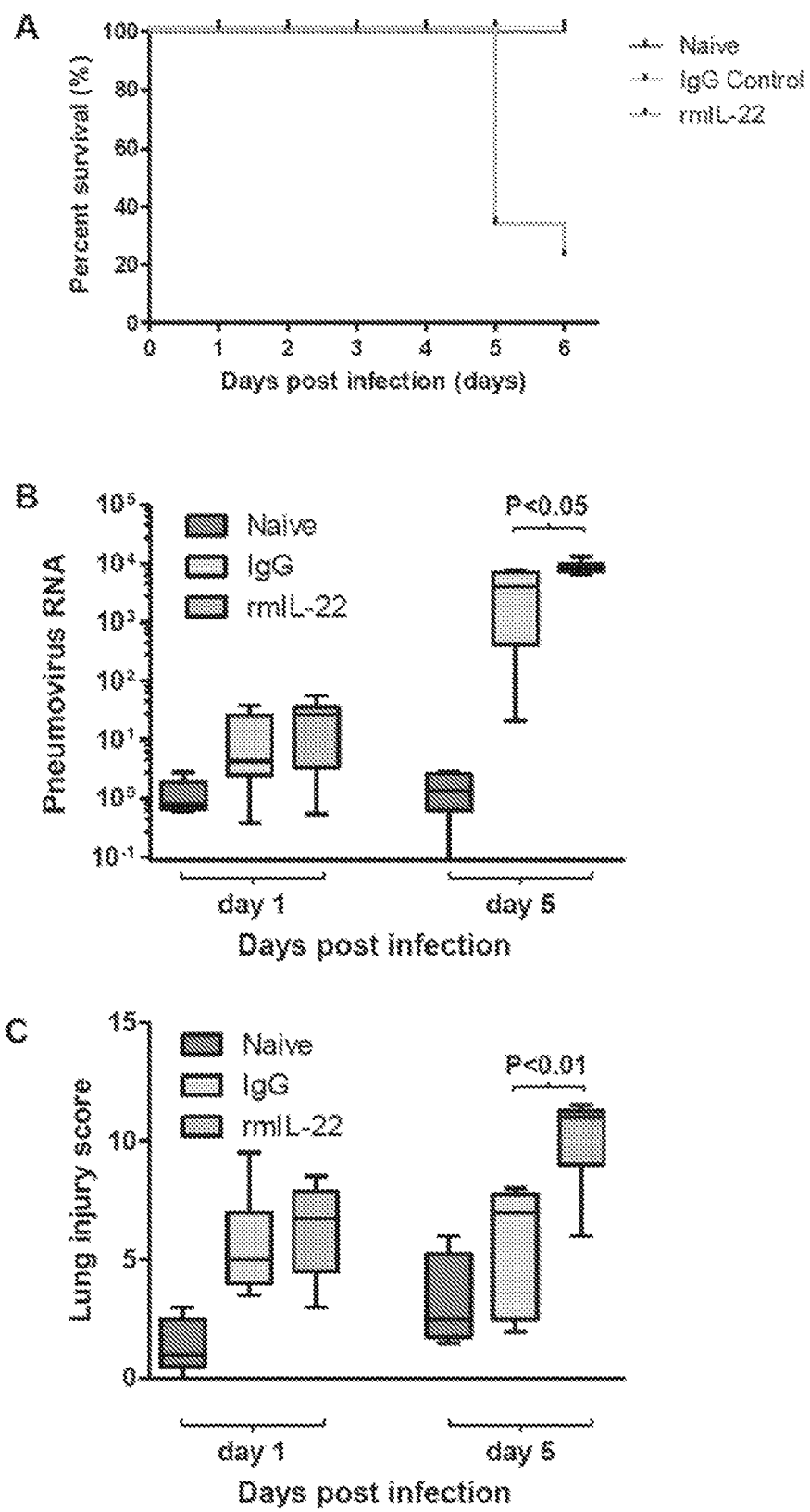
FIG. 20: Survival, viral titer and histological lung injury and inflammation scores in mice infected with pneumovirus (PVM) with and without IL-22 administration. Neonatal C57BL/6 mice were treated with either recombinant mouse IL-22 (rmIL-22, 20 ng/g i.p. every 3 days), or and irrelevant IgG antibody control (12.5 µg/mouse i.p. every six days) prior to infection with 100 plaque forming units (PFU) of pneumovirus of mice (PVM) or mock infection (naïve) at 7 days of age. Mice were infected intranasally, and sacrificed 1, 5 and 6 days post infection (DPI). (A) Mouse survival (7/9 IL-22 treated mice died between day 5 and day 6 and the experiment was ceased on day 6). (B) Abundance of PVM viral RNA measured by qRT-PCR. Expressed as fold change compared to mean of naïve group of respective DPI after correction for expression of the housekeeping gene β-actin. (C) Blinded lung injury and inflammation scores from hematoxylin and eosin stained sections. Statistics: (A) Kaplan-Meier survival curve (B, C) Box plots show median, IQR and range. N=9 mice/group; one-way ANOVA with Dunnett post-hoc test as shown.
Figure 21:
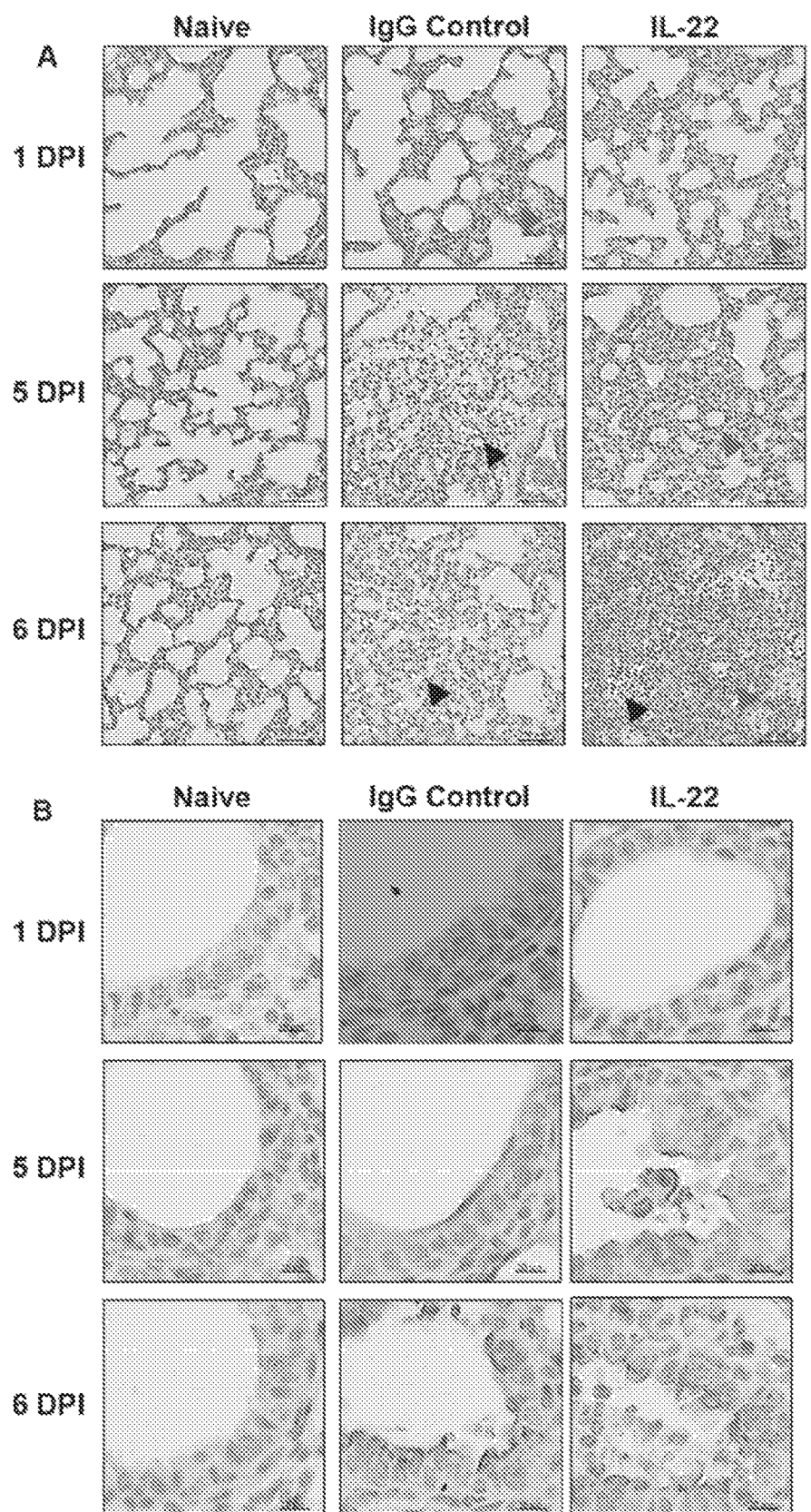
FIG. 21: Representative H&E-stained and PVM-stained lung sections from mice infected with pneumovirus (PVM) with and without IL-22 administration. (A) H&E sections showing inflammation in small airways. Arrows highlight immune cells in air spaces and intra-alveolar interstitium. (B) Rabbit anti-mouse PVM immunohistochemical staining.

Although the expression of the unique element of the IL-22 receptor heterodimer, IL-22R1, is most highly expressed in the pancreas, high expression of is also seen in the skin, intestine and liver (human gene expression from GTex is shown is FIG. 19). However, in the experiments described above, with administration of up to 100 µg/kg of IL-22 for up to 30 days no pathology was observed in the skin, intestine or liver. However, several lines of evidence suggest that chronic high dose IL-22 therapy would lead to pathology in these tissues.

High concentrations of IL-22 are found in the skin during inflammation in psoriasis and antagonism of IL-22 alleviates psoriatic pathology. High concentrations of IL-22 in the skin drive proliferation adding to the development of psoriatic lesions, in part by upregulating serine proteases. IL-22-producing CD8 T cells have been found associated with transplant-associated skin cancers and possibly contribute to squamous cell carcinoma growth or development in this setting.

IL-22 is generally thought to be a protective cytokine in the intestine, bolstering mucosal defense and driving proliferation in the intestine during wound repair following infectious damage. However, chronic high concentrations of IL-22, and low concentrations of the counteracting IL-22 binding protein, have been shown to contribute to hyperplasia and tumor development in the intestine in animal models.

The present inventors found that IL-22 suppressed ER stress in the liver, and others have reported favorable effects of IL-22 in mouse models of acute alcohol-induced liver injury, ischemia-reperfusion injury, fatty liver disease, toxin-induced liver damage and in viral hepatitis. However, IL-22 has been reported to induce hepatocyte proliferation and when IL-22 was over-expressed under the albumin promoter in the liver in mice, there were increased rates of carcinogen-induced liver cancers. IL-22 is found associated with human hepatocarcinomas, and carcinogen-induced liver cancers are reduced in IL-22$^{-/-}$ mice.

Example 11

Figure 23:
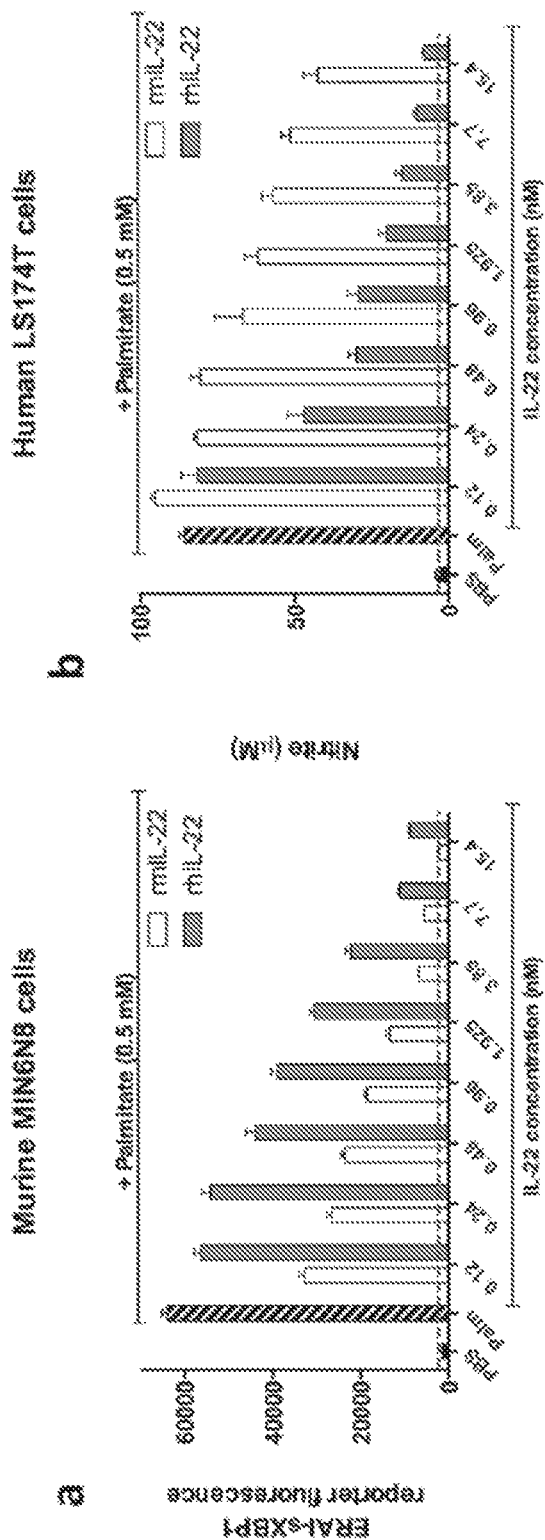
FIG. 23: Human and mouse recombinant IL-22 reduce ER stress in murine cells and human cells, respectively. (a) Murine MIN6N8 cells were transfected with the ERAI-sXBP1 reporter. After 48 h cells were treated recombinant mouse (rm) or human (rh) IL-22 (0.12-15.4 nM concentrations) in the presence of 0.5 mM palmitate for 24 h. Data is presented as the fluorescence intensity. n=4 (pooled data from two individual experiments). (b) Human LS174T cells were treated with increasing concentrations of recombinant human or mouse IL-22 2 h prior to the introduction of 0.5 mM palmitate for 30 min. Cells were lysed and intracellular nitrite was measured using the Griess Assay. n=4 (pooled data from two individual experiments). Con=PBS (black bar/dotted line) and palmitate alone (0.5 mM; red bar). Histograms show mean±s.e.m. *# P<0.05, ## P<0.01, *### P<0.001 (from post hoc test); * versus untreated vehicle control, # versus IL-22 from alternate species at comparable concentration.

In-Vitro Assessment of Efficacy Human Vs Mouse IL-22 to Suppress Oxidative and ER Stress The experiment using the murine MIN6N8 cells presented in FIG. 23A demonstrates that human recombinant IL-22 reduces ER stress in murine cells, however ~16-fold more human recombinant IL-22 was required to have the same effect as recombinant mouse IL-22. Similarly using the human LS174T cells, ~64-fold higher concentrations of mouse recombinant IL-22 were required to have the same effect as human recombinant IL-22 in suppressing oxidative stress (as measured by nitrite production, FIG. 23B).

Conclusions:

Mouse and human IL-22 have 79% amino acid identity and these experiments show they have reduced efficacy against the IL-22 receptor from the alternate species. It is feasible to use human IL-22 in in vitro experiments with murine cells and in in vivo experiments in mice, but considerably higher concentrations of cytokine will likely be required to have the same effect as murine IL-22. Additional factors that need to be considered in the in vivo experiments include: (a) human IL-22 may also have reduced affinity for the soluble IL-22 binding protein (IL-22RA2) and this may reduce inactivation and increase in vivo efficacy; (b) prolonged use of human IL-22 in mice may induce an antibody response resulting in more rapid clearance and impaired activity.

Example 12

In-Vitro Assessment of Protection from Er and Oxidative Stress by Human IL-22-IL-22-ScaB1 scFv Construct Relative to IL-22

Figure 24:
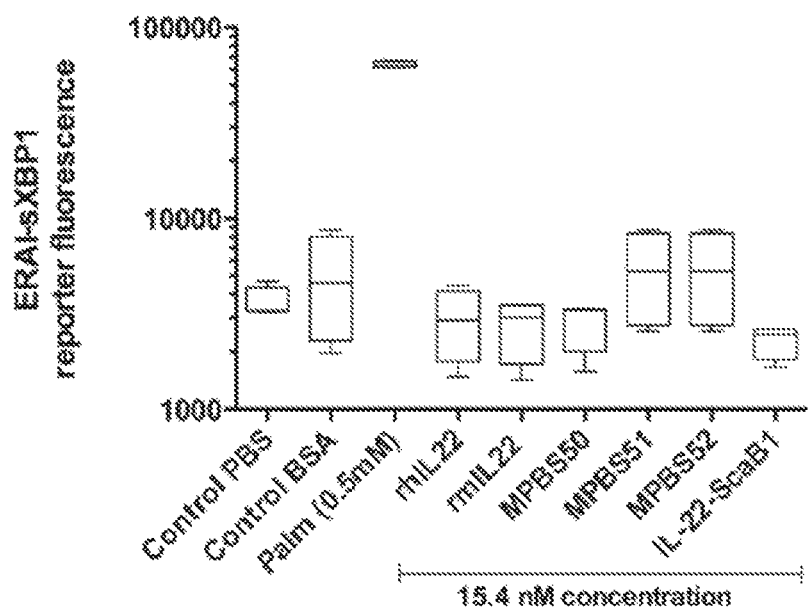
FIG. 24: Modulation of oxidative and ER stress in murine MIN6N8 cells exposed to palmitate, to recombinant mouse and human IL-22, to IL-22-GLP-1R ligand fusion proteins or to IL-22-ScaB1 scFv construct. MIN6N8 cells transfected with the ERAI-sXBP1 reporter were treated with 0.5 mM palmitate and recombinant mouse IL-22 (rmIL-22), recombinant human IL-22 (rhIL-22) and the IL-22-GLP-1R ligand fusion proteins (MPBS-50, -51 and -52) and IL-22 ScaB1 at 15.4 nM concentrations for 24 hours. PBS and 0.5% BSA were used as vehicle controls. Data shows that recombinant IL-22 and the biologic drugs do not cause any ER stress alone.

FIG. 24 shows ER stress in MIN6N8 cells exposed to palmitate, or to the recombinant mouse and human IL-22 and each of the IL-22-GLP-1R ligand fusion proteins and an IL-22-single chain antibody construct targeting a β-cell antigen (IL-22-ScaB1) at the highest concentrations used in the parallel experiments. As expected, palmitate induced ER stress but recombinant mouse IL-22, human IL-22, the IL-22-GLP-1R ligand fusion proteins, MPBS-50, MPBS-51 and MPBS-52 (see, FIG. 36), and the IL-22-ScaB1 fusion protein (see, FIG. 34) did not cause ER stress.

Figure 25:
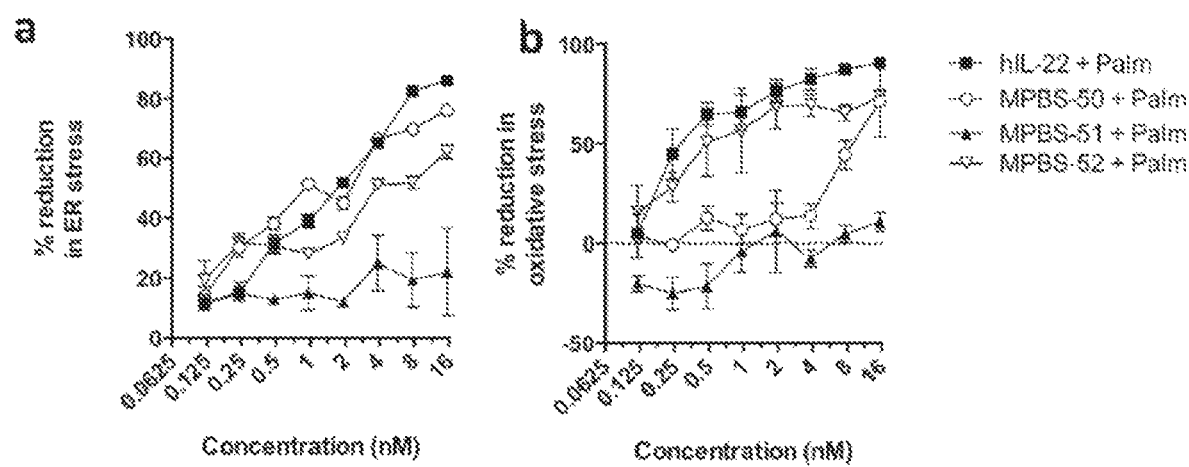
FIG. 25: Protection against oxidative and ER stress in murine MIN6N8 cells or human LS174T cells concomitantly exposed to palmitate and mouse or human IL-22 or different IL-22-GLP-1R ligand fusion proteins. (A) MIN6N8 cells were transfected with the ERAI-sXBP1 reporter were co-treated with 0.5 mM palmitate and increasing concentrations of recombinant human IL-22 (hIL-22) and the IL-22-GLP-1R ligand fusion proteins (MPBS-50, -51 and -52) for 24 hours. N=4 (pooled data from two individual experiments). Data is presented as a percentage reduction of ER stress. (B) LS174T cells were treated with increasing concentrations of recombinant mouse IL-22 (mIL-22), recombinant human IL-22 (hIL-22) and the IL-22-GLP-1R ligand fusion proteins (MPBS-50, 51 and 52) for 2 h prior to the introduction of 0.5 mM palmitate for 30 min. Cells were subsequently lysed and the Griess assay was used to determine the nitrite concentration. N=4 (pooled data from two individual experiments). Data is presented as a percentage reduction of oxidative stress (nitrite concentration).

FIG. 25A shows protection from ER stress in murine MIN6N8 β-cells concomitantly exposed to palmitate and human IL-22 or the 3 IL-22-GLP-1R ligand fusion proteins. MBPS-50 inhibited ER stress in a dose dependent manner at a similar efficacy to a molar equivalent concentration of human IL-22. MPBS-51 did not effectively suppress ER stress at any of the concentrations tested. MPBS-52 effectively suppressed ER stress, but showed a somewhat unusual titration curve with lower efficacy than human IL-22 at high concentrations and greater efficacy at lower concentrations.

FIG. 25b shows protection from oxidative stress in human LS174T colon cells concomitantly exposed to palmitate and murine IL-22, human IL-22 or the 3 NN-IL-22-GLP-1R ligand fusion proteins. MBPS-50 inhibited oxidative stress (nitrite production) but only toward the highest end of the concentration range used, being less effective than molar equivalent concentrations of human IL-22. MPBS-51 did not effectively suppress oxidative stress at any of the concentrations tested, and in fact appeared to increase palmitate-induced nitrite production at the lower end of the concentration range. MPBS-52 effectively suppressed oxidative stress with a similar efficacy to equivalent molar concentrations of human IL-22.

Figure 26:
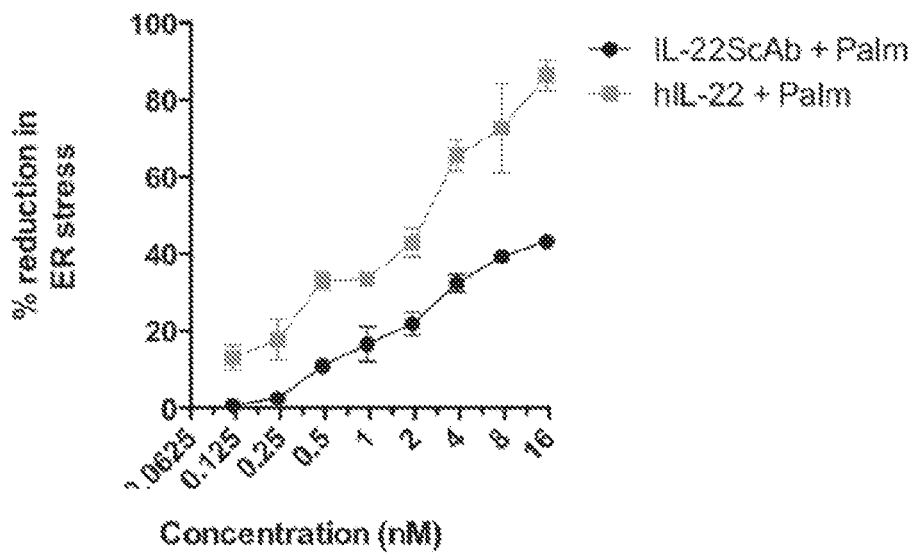
FIG. 26: Reduction of ER stress by IL-22-ScaB1. Reduction of ER stress by IL-22-ScaB1. MIN6N8 cells transfected with the ERAI-sXBP1 reporter were co-treated with 0.5 mM palmitate and increasing concentrations of recombinant human IL-22 (hIL-22) and the IL-22-ScaB1 for 24 hours. N=4. Data is presented as a percentage reduction of ER stress.

FIG. 26 shows a reduction in ER stress in MIN6N8 cells exposed to palmitate concomitantly with human IL-22 or the IL-22-ScaB1 fusion protein.

Conclusions:

The MPBS-50 and MPBS-52 fusion proteins have retained in vitro efficacy for suppression of ER and oxidative stress, demonstrated in both murine and human cells. Interestingly, MPBS-50 was more efficacious than MPBS-52 in the murine β-cells whereas MPBS-52 was more efficacious in the human colon cells. Conversely, MPBS-51 appears inactive in-vitro. IL-22-ScaB1 reduced ER stress induced by palmitate but was at <50% potency compared to the native human IL-22.

Example 13

In-Vivo Assessment of the Clearance of IL-22 Fusion Protein

Figure 27:
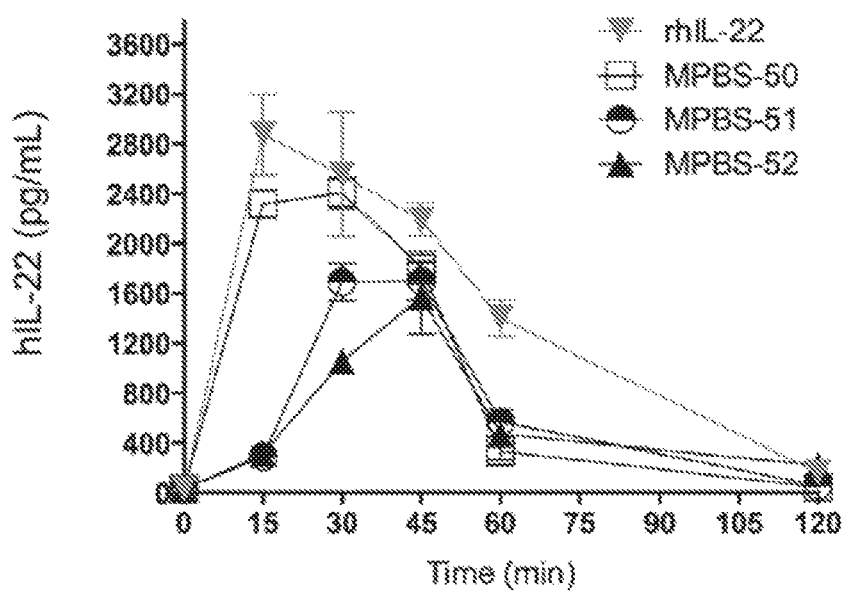
FIG. 27: Clearance of IL-22 and IL-22 fusion proteins. Mice were injected with 256 ng/g of human IL-22 or the molar equivalents of NN-IL-22-GLP-1R ligand fusion proteins (MPBS-50, -51,-52). Blood samples were collected at different time points as shown.

FIG. 27 shows the concentrations of recombinant mouse and human IL-22, and the 3 IL-22-GLP-1R ligand fusion proteins in serum over the first 2 hours following administration. As previously documented mouse IL-22 is almost completely cleared within 60 min of administration (not shown). Human IL-22 was cleared slightly more slowly and the 3 fusion proteins gave slightly differing patterns of clearance. MPBS-50 was cleared with similar kinetics to recombinant human IL-22, whereas MPBS-51 and MPB-52 showed a lower and somewhat more extended/later peak concentration.

Example 14

In-Vivo Assessment of Relative Activation of Stat3 by Human IL-22-GLP-1R Ligand Fusions in Pancreatic Islets Vs. Other Target Tissue (Liver, Skin, Gut)

Figure 28:
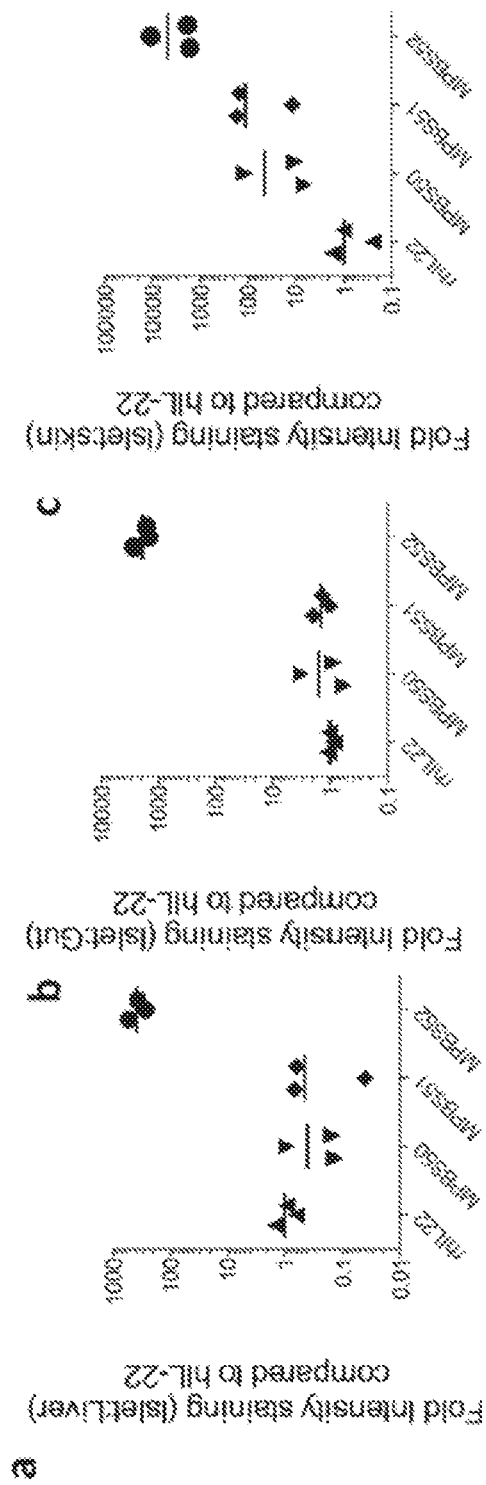
FIG. 28: Assessment of specific targeting to the pancreatic islets of IL-22-GLP-1R ligand fusion protein. IL-22 receptor expressing tissues (liver, intestine, skin and pancreas) from mice treated with 256 ng/g of recombinant human IL-22 or the molar equivalents of IL-22-GLP-1R ligand fusion proteins (MPBS-50, -51, -52) for 30 min were stained with pStat3 antibody. The intensity of fluorescence per area was assessed using image J software in 3-4 fields of view for each tissue in each mouse (n=3). Within each mouse the mean fluorescence density from multiple fields was calculated for each tissue and then the ratio of pancreatic islet staining intensity in each of the other tissues (a; liver, b; intestine, c; skin) was calculated. Results are presented as fold change relative to that observed with recombinant human IL-22 (rhIL-22).

FIG. 28 shows the relative STAT3 fluorescence (determined per tissue area) in pancreatic islets vs. liver, intestine and skin 30 min after the administration of each form of human IL-22. Results are expressed as a fold change in the tissue ratios relative to administration of human IL-22. The ratio for MPBS-50 and -51 were not greater than for native human IL-22 in the liver or intestine, but showed 45- and 113-fold mean increases in STAT3 phosphorylation in the islet vs the skin compared to native IL-22. Interestingly, although we observed no effect of MPBS-51 in reducing ER/oxidative stress in vitro, it did induce STAT3 phosphorylation in the pancreas as well as liver and gut suggesting it is activated in vivo, possibly via DPPIV protease-mediated cleavage. In contrast to MPBS-50 and MPBS-51, MPBS-52 showed substantially increased targeting to the pancreatic islets, relative to liver (396-fold), intestine (338-fold) and skin (4,840-fold). These findings provide proof of principle that GLP-1R-targeting can enhance IL-22 activity in the pancreatic islets relative to the IL-22 target tissues that may show undesired adverse effects.

Conclusions:

All three fusion proteins improved targeting to the islets vs. skin and MPBS-52 administration resulted in very substantially increased STAT3 phosphorylation in the islets vs. liver, skin and intestine. These data provide initial proof of principle that IL-22-GLP-1R ligand fusion proteins can be used to enhance targeting of IL-22 to the pancreatic islets with potentially enhanced therapeutic outcomes.

Example 15

In-Vivo Assessment of Relative Activation of Stat3 by Human IL-22-ScaB1 scFv Construct in Pancreatic Islets Vs. Other Target Tissue (Liver, Skin, Gut)

Figures 29A, 29B, 29C:
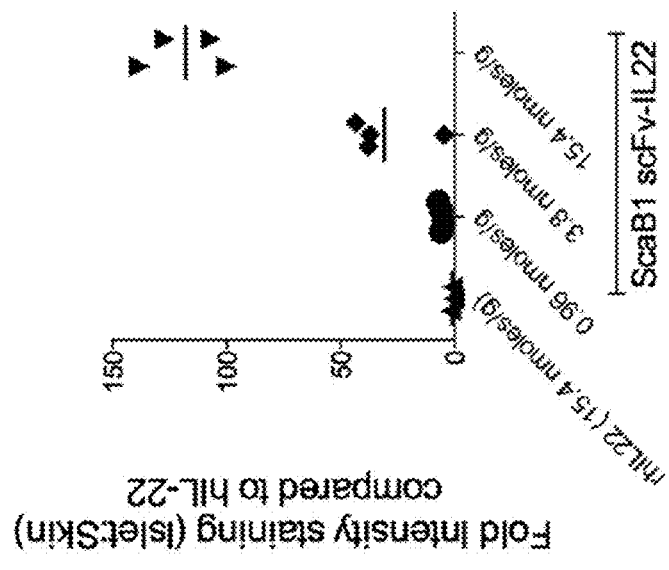

FIG. 29 shows the relative STAT3 fluorescence (determined per tissue area) in pancreatic islets vs. liver, intestine and skin 30 min after the administration of human IL-22 at the highest doses of 15.4 nmoles/g and increasing concentrations of IL-22-ScaB1 (0.96-15.4 nmoles/g). Results are expressed as a fold change in the tissue ratios relative to administration of human IL-22. The ratio for IL-22-ScaB1 at 0.96 nmoles/g were not greater than for native human IL-22 at the highest concentration in the liver, skin or intestine. However at the two higher doses IL-22-ScaB1 showed substantially increased targeting to the pancreatic islets, at 15.4 nmoles/g relative to liver a 120-fold, in the intestine a 420-fold and in the skin a 110-fold increase was observed. These findings provide proof of principle that targeting (by multiple methods) can enhance IL-22 activity in the pancreatic islets relative to the IL-22 target tissues that may show undesired adverse effects.

Conclusions:

IL-22-ScaB1 proteins improved targeting to the islets vs. other IL-22RA1 expressing tissue such as liver, skin and intestine. These data provide initial proof of principle that IL-22-fusion with antibody proteins can be used to enhance targeting of IL-22 to the pancreatic islets with potentially enhanced therapeutic outcomes.

Example 16

Figure 30:
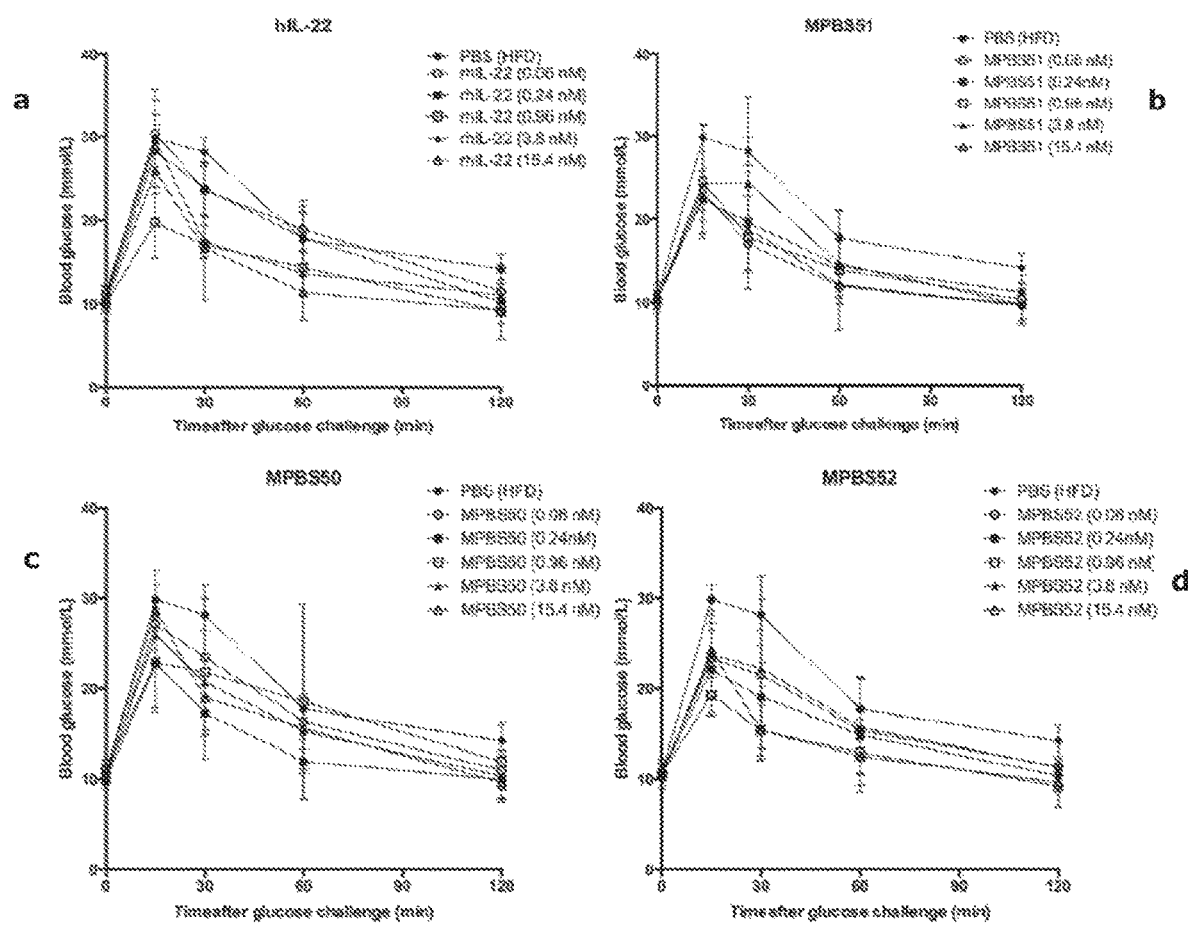
FIG. 30: Dose-finding efficacy study in mice with high fat diet induced obesity with IL-22-GLP-1R ligand fusion proteins. Mice were fed a high fat diet (HFD) or normal chow diet (NCD) for 27 weeks. HFD mice were treated with 0.06-15.4 nmoles/g of recombinant human IL-22 (rhIL-22) (a) or IL-22-GLP-1R ligand fusion proteins (MPBS-50 (c), -51 (b), 52 (d)). Glucose tolerance was measured by an intraperitoneal (i.p.) glucose tolerance test (IPGTT) (fasted mice were given 40% glucose 2 g/kg i.p. and blood glucose measured over 120 min).
Figure 31:
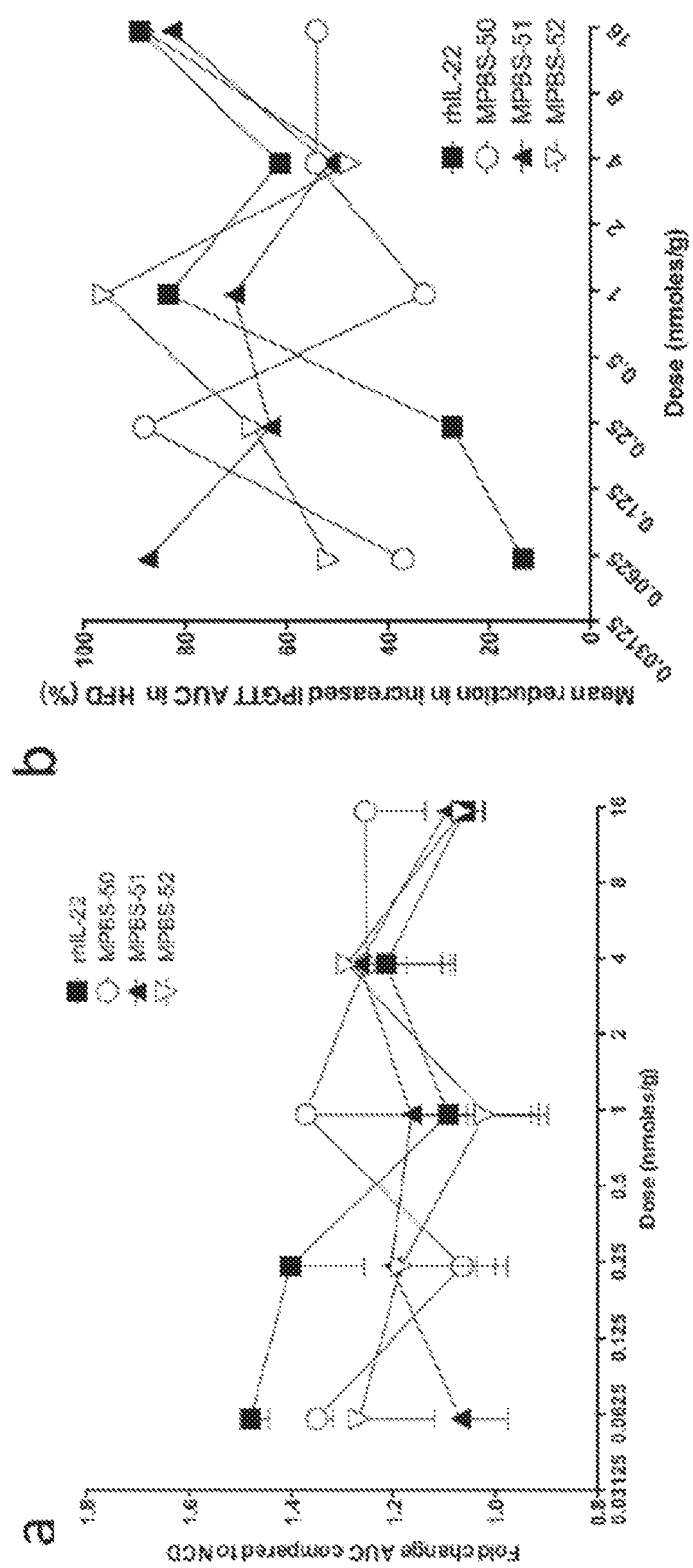
FIG. 31: IL-22-GLP-1R ligand fusion proteins are more efficacious than rhIL-22 at lower doses. Mice were fed a high fat diet (HFD) or normal chow diet (NCD) for 27 weeks. HFD mice were treated with 0.06-15.4 nmoles/g of recombinant human IL-22 (rhIL-22) or IL-22-GLP-1R ligand fusion proteins (MPBS-50, -51, -52). Glucose tolerance was measured by an intraperitoneal (i.p.) glucose tolerance test (IPGTT) (as in FIG. 30). Data is presented as the percentage mean reduction in the increase of the IPGTT area under the curve (AUC) compared to NCD alone (a) and HFD alone (b).

Dose-Finding Efficacy Study in Mice with High Fat Diet Induced Obesity with IL-22-GLP-1R Ligand Fusion Proteins This stage of testing involved a two-week therapy across a range of five doses (0.06-15.4 nmoles/g) of human IL-22 and the IL-22-GLP-1R ligand fusion proteins in mice that had been on a high fat diet (HFD) for 27 weeks. After two weeks glycemic control was assessed by an intraperitoneal glucose tolerance test (IPGTT; all doses compared to HFD shown in FIG. 30). FIG. 31B shows that the IL-22-GLP-1R ligand fusion proteins are more potent at a lower dose in lowering IPGTT AUC compared to native IL-22, and reduce AUC of the IPGTT effectively to that observed in normal chow diet (value of 1). Doses of IL-22 or the IL-22-GLP-1R ligand fusion proteins >0.96 nmoles/g gave a mean reduction in the increased area under the curve (AUC) of the IPGTT of the HFD vs normal chow fed control mice of >50% (FIG. 31B).

Figure 32:
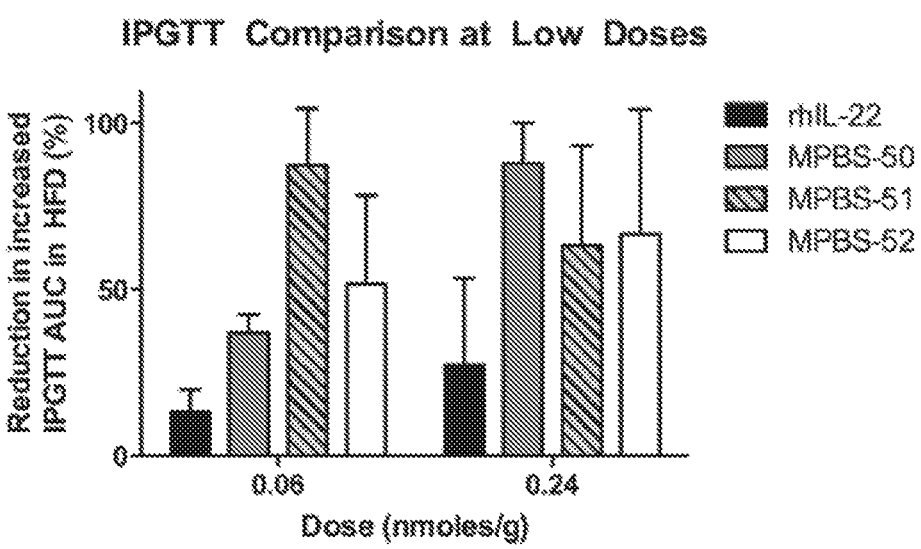
FIG. 32: Assessment of therapeutic efficacy of IL-22-GLP-1R ligand fusion proteins. Mice were fed a high fat diet (HFD) or normal chow diet (NCD) for 27 weeks. HFD mice were treated with 0.06-15.4 nmoles/g of recombinant human IL-22 (rhIL-22) or IL-22-GLP-1R ligand fusion proteins (MPBS-50, 51, 52). Glucose tolerance was measured by a fasted intraperitoneal (i.p.) glucose tolerance test (IPGTT) (as in FIG. 30), blood samples were obtained before challenge and following 15, 30, 60 and 120 min. Data from the two lowest doses of proteins is presented as the percentage mean reduction in the increased area under the IPGTT curve in control PBS-treated HFD mice.
Figure 33:
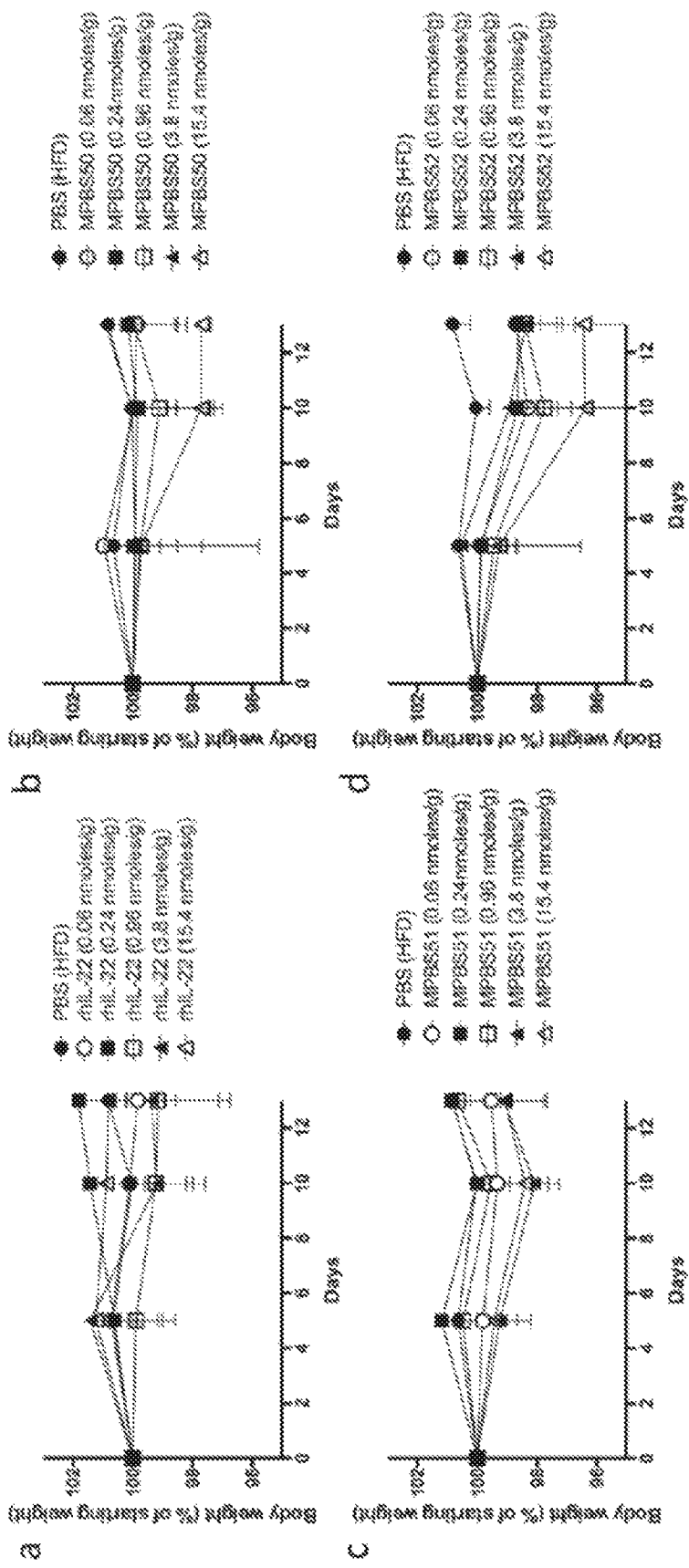
FIG. 33: Body weight changes. Mice were fed a high fat diet (HFD) or normal chow diet (NCD) for 27 weeks. HFD mice were treated with 0.06-15.4 nmoles/g of recombinant human IL-22 (a; rhIL-22) or IL-22-GLP-1R ligand fusion proteins (b; MPBS-50, c; -51, d; -52). Body weight changes were recorded on days 0, 5, 10 and 13. Data is presented as a percentage of starting body weight on day 0.

Below this dose the three IL-22-GLP-1R ligand fusion proteins remained active whereas the efficacy of human IL-22 diminished substantially (see, FIG. 32). The increased efficacy of the IL-22-GLP-1R ligand fusion proteins is consistent with improved targeting of IL-22 to the pancreatic islets (FIG. 28). Body weight changes were also assessed during treatment, revealing trends toward increased body weight loss at the highest doses of the IL-22-GLP-1R ligand fusion proteins, whereas there was little change in body weight with human IL-22 (FIG. 33). These findings provide encouraging proof of principle of the increased efficacy of the IL-22-GLP-1R ligand fusion proteins vs. native IL-22 for restoring glycemic control in obesity/diabetes.

Material and Methods for Examples 11 to 16

Production of His-ScaB1 scFv-IL22 Human-Myc (Referred to as IL-22-ScaB1)

Fusion Protein Sequence Design:

The first requirement for the development of a fusion protein able to specifically target pancreatic β-cells was to select a targeting moiety to connect to the human IL-22 sequence. The ScaB1 single chain variable fragment (scFv) was identified as a potential means to facilitate targeting. DNA sequences for the scFv were sourced from WO 2010/096930. The coding sequence was modified slightly to remove parts that were unnecessary, such as extra restriction enzyme sites, linker extensions, signal peptides and artefacts (e.g. -AAA at C-terminal end of the sequence in WO 2010/096930) relating to the original method use in developing the scFv (see, FIG. 34A).

Human IL-22 sequences were identified using the NCBI and Uniprot databases: hypertext transfer protocol, world wide web, ncbi.nlm.nih.gov/gene?Cmd=DetailsSearch&Term=50616; and hypertext transfer protocol, world wide web, uniprot.org/uniprot/Q9GZX6. The final human IL-22 sequence used excluded the signal peptide included in all online resources as its presence would result in cleavage of the fusion protein during mammalian expression (FIG. 34B). Sequences were then connected by means of a single G45 linker to form a scFv-cytokine fusion protein with a N-terminal 6×His- and a C-terminal myc-tag to aid in protein detection during product development (FIG. 34C).

The initial fusion protein coding sequence was optimized by removing codons that could cause unwanted effects such as additional cuts in the sequence when performing routine restriction enzyme digests for cloning purposes. The designed DNA sequence was optimized for expression in Chinese hamster ovary (Cricetulus griseus) cells and included a 5' leader sequence (MGWSCIILFLVATATGVHS [SEQ ID NO:293]) from the published MAB Xpress system and a Kozak sequence for initiation of translation.

Molecular Biology:

The fusion protein was ordered through GeneArt using their custom gene synthesis service and subsequently sub-cloned into pcDNA 3.1(+) using HindIII and XbaI restriction sites (New England Biolabs, NEB). Colonies were grown on LB agar plates using ampicillin resistance as selective pressure for positive pcDNA3.1 (+) colonies. Presence of the inserted fusion protein DNA sequence was confirmed through routine colony PCR and subsequent Sanger sequencing using T7-Forward (TAATACGACTCAC-TATAGGG [SEQ ID NO:294]) and BGH-reverse (TAGAAGGCACAGTCGAGGC [SEQ ID NO:295]) primers that have sites 5' and 3' to the insert site on the vector backbone. Sequence alignment performed using the online tool, Clustal Omega, confirmed presence of the fusion protein sequence. A large scale E. coli expression (ampicillin selection) was then completed to produce enough DNA to purify (Macherey-Nagel, NucleoBond® Xtra Midi kit) and use for mammalian expression in suspension adapted CHO cells.

Mammalian Expression:

Aseptic techniques were maintained during cell culture protocols and completed in Class II biosafety cabinets, routinely cleaned using 80% (V/V) ethanol and UV sterilized. Media was prepared in the cabinets and heated to 37° C. in a water bath located external to the cabinet but still within an area dedicated to large-scale quality protein production. Transient expression of the fusion protein was performed using PEI-mediated transfection, whereby DNA and PEI are diluted in OptiProSFM, mixed and added to suspension adapted CHO cells in chemically defined CD-CHO (Gibco, Life Technologies) media supplemented with 8 mM Glutamax. Transfected cells were initially kept at 37° C., 7.5% CO2 and 130 rpm. Following a 5-hour incubation time a feed composed of CD-CHO+8 mM Glutamax, 0.4% (v:v) anti-clumping agent (ACA), 7.5% (v:v) each of Feed A and Feed B (Gibco, Life Technologies) was added to the cells in the biosafety cabinet to dilute the cultures 1:2 (v:v) in 1 L shaker flasks (Corning), as previously described in Codamo et al. (2011).

Protein Purification:

Culture supernatants were harvested 10 days post-transfection by centrifugation then filtered using a 0.22 μm bottle top filter (Corning). The pH was adjusted to 7.3 and supernatant stored at 4° C. until purification could be completed. As the scFv included a variable Kappa (VK) subgroup I chain, this provided the means to purify the fusion protein using pre-packed HiTrap protein L columns (GE Healthcare Life Sciences) rather than the more time consuming process of immobilized metal affinity chromatography (IMAC) which binds His-tags for purification. The protocol included 15 mM NaOH for sterilization and cleaning, 1× Dulbecco's PBS (Life Technologies) as wash and running buffer, and 0.1 M Glycine pH 3.0 for protein elution. Eluted protein was subsequently desalted into 1× Dulbecco's PBS using a HiPrep desalting column (GE Healthcare Life Sciences). Following purification the purified product was run under reduced and non-reduced conditions on a NuPAGE® Novex® 4-12% Bis-Tris Protein Gel alongside the SeeBlue Plus2 pre-stained protein marker (Life Technologies). The results showed that the purification protocol was effective in producing quality amounts of pure fusion protein with no visible contaminants (FIG. 35). Further analytical experiments are yet to be completed to determine final yield quality.

IL-22-GLP-1R Ligand Fusions Proteins:

These fusion proteins were made by Novo Nordisk A/S (Bagsvaerd, Denmark) and their sequences are provided in FIG. 36.

In-Vitro Experiments:

Cell culture: Murine MIN6N8 cells were tested negative for mycoplasma. Cells were routinely cultured in phenol-red free DMEM (Life Technologies) containing 25 mM glucose (3.4 g/L sodium bicarbonate, 50 U/mL penicillin and streptomycin, 71.5 μM β-mercaptoethanol and 10% heat inactivated fetal bovine serum) and transferred to DMEM as above with 5.5 mM glucose 48 h prior to experimentation. Human LS174T cells were cultured in DMEM containing 10% heat-inactivated fetal bovine serum, 50 U mL$^{-1}$ penicillin and streptomycin.

ER Stress Measurement: MIN6N8 cells were transfected with the ERAI reporter plasmid (F-XBP1ΔDBD-venus, using Lipofectamine 2000 according to the manufacturer's instructions. For ERAI there was negligible fluorescence in the absence of ER stressors, but upon induction of ER stress, splicing of XBP1 mRNA by IRE1a results in the translation of Venus but not an active form of XBP1. Fluorescence was measured (excitation: 485 nm; emission: 520 nm) using a POLARstar Omega plate reader and cells were treated 48 h after transfection. 48 h post-transfection cells were exposed to 0.5 mM palmitate to induce ER stress and concomitantly treated with mouse or human IL-22 over a range of concentrations (0.12-15.4 nM). After 24 h, ERAI-sXBP1 GFP reporter fluorescence was measured.

Oxidative Stress Measurement: Cells were exposed to 0.5 mM palmitate to induce ER stress and concomitantly treated with mouse or human IL-22 over a range of concentrations (0.12-15.4 nM) for 2 h. The Griess Reagent Kit for Nitrite Determination was performed according to the manufacturer's instructions (Molecular Probes) to assess the intracellular levels of nitrite (the stable metabolite of nitric oxide) using lysates of β-cells prepared in RIPA buffer (150 mM NaCl, 1% NP40, 0.5% sodium deoxycholate, 0.1% SDS, 50 mM Tris, pH 7.5).

In-Vivo Animal Experiments:

Targeting to IL-22 to pancreas: Non-obese male C57BL/6 at 6-8 weeks of age. Each IL-22-GLP-1R ligand fusion protein or hIL-22 was administered i.p. at 256 ng/g of IL-22 and the molar equivalents for the individual fusion proteins (n=3 per regimen). IL-22-ScaB1 was administered at 15.4 nmoles/g, 3.8 nmoles/g and 0.96 nmoles/g. Control mice received a PBS control i.p. injection only.

To assess clearance of IL-22 and IL-22-GLP-1R ligand fusion proteins blood samples were collected before injection and at 15, 30, 45, 60, 90 and 120 min. Serum concentrations of IL-22 and the IL-22-GLP-1R ligand fusion proteins were determined using a human IL-22 double-determinant ELISA (Biolegend; 434505) against a standard curve for the individual fusion proteins.

To assess in vivo activation of the IL-22 receptor signaling pathway, after 30 min the mice were sacrificed and the following tissues were snap frozen and sections were prepared for each mouse: pancreas, skin (ear, tail), colon (rolled), and liver. Sections were stained by immunofluorescence for phosphorylated STAT3 using the Phospho-Stat3 (Tyr705) (D3A7) antibody.

Intra Peritoneal Glucose Tolerance Test:

C57BL/6 male mice from 6-8 weeks of age were fed a high fat diet containing 46% of available energy as saturated fat, 34% carbohydrate, 20% protein (Speciality feeds, SF04-027) for 27 weeks and treated as follows:

IL-22-GLP-1R ligand fusion protein or IL-22 alone were administered twice weekly i.p. at the following doses: 1, 4, 16, 64 and 256 ng/g of IL-22 (0.12-15.4 nmoles/g) and the molar equivalents for IL-22-GLP-1 fusion proteins (n=3 per regimen, except for the lowest dose where n=2); control mice received PBS control only. A fasted Intraperitoneal glucose tolerance tests (IPGTT) was performed (2 g kg-i glucose) on day 14 when the experiment was terminated (tissues were not kept for analysis). Body weight was recorded on days 0, 5, 10 and 13.

The disclosure of every patent, patent application, and publication cited herein is hereby incorporated herein by reference in its entirety.

The citation of any reference herein should not be construed as an admission that such reference is available as "Prior Art" to the instant application.

Throughout the specification the aim has been to describe the preferred embodiments of the invention without limiting the invention to any one embodiment or specific collection of features. Those of skill in the art will therefore appreciate that, in light of the instant disclosure, various modifications and changes can be made in the particular embodiments exemplified without departing from the scope of the present invention. All such modifications and changes are intended to be included within the scope of the appended claims.

BIBLIOGRAPHY

Aggarwal S, Xie M H, Maruoka M et al. Acinar cells of the pancreas are a target of interleukin-22. J Interferon Cytokine Res 2001; 21:1047-53.

Back S H, Scheuner D, Han J et al. Translation attenuation through eIF2alpha phosphorylation prevents oxidative stress and maintains the differentiated state in beta cells. Cell Metab 2009; 10:13-26.

Bleicher L, de Moura P R, Watanabe L et al. Crystal structure of the IL-22/IL-22R1 complex and its implications for the IL-22 signaling mechanism. FEBS Lett 2008; 582:2985-92.

Chestovich P J, Uchida Y, Chang W et al. Interleukin-22: implications for liver ischemia-reperfusion injury. Transplantation 2012; 93:485-92.

Cnop M, Foufelle F, Velloso, L A. Endoplasmic reticulum stress, obesity and diabetes Trends Mol Med 2012, 18(1): 59-68.

Cobleigh M A, Robek M D. Protective and pathological properties of IL-22 in liver disease: implications for viral hepatitis. Am J Pathol 2013; 182:21-8.

Codamo J, Munro T P, Hughes B S et al. Enhanced CHO cell-based transient gene expression with the epi-CHO expression system. Mol Blotechnol. 2011 June; 48(2): 109-15.

Coughlan M T, Yap F Y, Tong D C et al. Advanced glycation end products are direct modulators of beta-cell function. Diabetes 2011; 60:2523-32.

Cunha D A, Hekerman P, Ladriere L, et al. Initiation and execution of lipotoxic ER stress in pancreatic beta-cells. J Cell Sci 2008, 121:2308-18.

Cunha D A, Ladriere L, Ortis F et al. Glucagon-like peptide-1 agonists protect pancreatic beta-cells from lipotoxic endoplasmic reticulum stress through upregulation of BiP and JunB. Diabetes 2009; 58:2851-62.

de Oliveira Neto M, Ferreira J R, Jr., Colau D et al. Interleukin-22 forms dimers that are recognized by two interleukin-22R1 receptor chains. Biophys J 2008; 94:1754-65.

Dumoutier L, Lejeune D, Colau D et al. Cloning and characterization of IL-22 binding protein, a natural antagonist of IL-10-related T cell-derived inducible factor/IL-22. J Immunol 2001; 166:7090-5.

Farley E, Menter A. Psoriasis: comorbidities and associations. G Ital Dermatol Venereol 2011; 146:9-15.

Feng D, Kong X, Weng H et al. Interleukin-22 promotes proliferation of liver stem/progenitor cells in mice and patients with chronic hepatitis B virus infection. Gastroenterology 2012; 143:188-98 e7.

Fonseca S G, Urano F, Weir G C et al. Wolfram syndrome 1 and adenylyl cyclase 8 interact at the plasma membrane to regulate insulin production and secretion. Nat Cell Biol 2012; 14:1105-12.

Harding H P, Zhang Y, Ron D. Protein translation and folding are coupled by an endoplasmic-reticulum-resident kinase. Nature 1999; 397:271-4.

Huber S, Gagliani N, Zenewicz L A et al. IL-22BP is regulated by the inflammasome and modulates tumorigenesis in the intestine. Nature 2012; 491:259-63.

Iwawaki T, Akai R, Kohno K, et al. A transgenic mouse model for monitoring endoplasmic reticulum stress. Nat Med 2004; 10:98-102.

Jiang R, Tan Z, Deng L et al. Interleukin-22 promotes human hepatocellular carcinoma by activation of STAT3. Hepatology 2011; 54:900-9.

Jiang R, Wang H, Deng L et al. IL-22 is related to development of human colon cancer by activation of STAT3. BMC Cancer 2013; 13:59.

Ki S H, Park O, Zheng M et al. Interleukin-22 treatment ameliorates alcoholic liver injury in a murine model of chronic-binge ethanol feeding: role of signal transducer and activator of transcription 3. Hepatology 2010; 52:1291-300.

Kim S, Chae S Y, Na K et al. Insulinotropic activity of sulfonylurea/pullulan conjugate in rat islet microcapsule. Biomaterials 2003; 24:4843-51.

Kirchberger S, Royston D J, Boulard O et al. Innate lymphoid cells sustain colon cancer through production of interleukin-22 in a mouse model. J Exp Med 2013; 210:917-31.

Klemm D J, Leitner J W, Watson P et al. Insulin-induced adipocyte differentiation. Activation of CREB rescues adipogenesis from the arrest caused by inhibition of prenylation. J Biol Chem 2001; 276:28430-5.

Lee Y S, Jun H S. Anti-diabetic actions of glucagon-like peptide-1 on pancreatic beta-cells. Metabolism 2014; 63:9-19.

Li J, Tomkinson K N, Tan X Y et al. Temporal associations between interleukin 22 and the extracellular domains of IL-22R and IL-10R2. Int Immunopharmacol 2004; 4:693-708.

Li W, Danilenko D M, Bunting S et al. The serine protease marapsin is expressed in stratified squamous epithelia and is up-regulated in the hyperproliferative epidermis of psoriasis and regenerating wounds. J Biol Chem 2009; 284:218-28.

Lupo B, Bataille D. A binding site for [3H]glipizide in the rat cerebral cortex. Eur. J. Pharmacol. 1987; 140:157-169.

Ma H L, Liang S, Li J et al. IL-22 is required for Th17 cell-mediated pathology in a mouse model of psoriasis-like skin inflammation. J Clin Invest 2008; 118:597-607.

Maggi E, Painezzola E, Valzelli G. Radioimmunoassay of glipizide in human plasma. Eur. J. Clin. Pharmacol. 1981; 21:251-255.

Mandi T, Hanzelmann S, Salehi A et al. Secreted frizzled-related protein 4 reduces insulin secretion and is overexpressed in type II diabetes. Cell Metab 2012; 16:625-33.

Malhi H, Kaufman R J. Endoplasmic reticulum stress in liver disease. J Hepatol 2011; 54:795-809.

Malhotra J D, Kaufman R J. ER stress and its functional link to mitrochondria: role in cell survival and death. *Semin Cell Dev Biol* 2007, 18(6):716-31.

Miyazaki J, Araki K, Yamato E et al. Establishment of a pancreatic beta cell line that retains glucose-inducible insulin secretion: special reference to expression of glucose transporter isoforms. Endocrinology 1990; 127:126-32.

Nagem R A, Colau D, Dumoutier L et al. Crystal structure of recombinant human interleukin-22. Structure 2002; 10:1051-62.

Nielsen L B, Ploug K B, Swift P et al. Co-localisation of the Kir6.2/SUR1 channel complex with glucagon-like peptide-1 and glucose-dependent insulinotrophic polypeptide expression in human ileal cells and implications for glycaemic control in new onset type 1 diabetes. Eur J Endocrinol 2007; 156:663-71.

Ota N, Wong K, Valdez P A et al. IL-22 bridges the lymphotoxin pathway with the maintenance of colonic lymphoid structures during infection with *Citrobacter rodentium*. Nat Immunol 2011; 12:941-8.

Ouyang W. Distinct roles of IL-22 in human psoriasis and inflammatory bowel disease. Cytokine Growth Factor Rev 2010; 21:435-41.

Pan H, Hong F, Radaeva S et al. Hydrodynamic gene delivery of interleukin-22 protects the mouse liver from concanavalin A-, carbon tetrachloride-, and Fas ligand-induced injury via activation of STAT3. Cell Mol Immunol 2004; 1:43-9.

Park O, Wang H, Weng H et al. In vivo consequences of liver-specific interleukin-22 expression in mice: Implications for human liver disease progression. Hepatology 2011; 54:252-61.

Pickert G, Neufert C, Leppkes M et al. STAT3 links IL-22 signaling in intestinal epithelial cells to mucosal wound healing. J Exp Med 2009; 206:1465-72.

Pyke C, Heller R S, Kirk R K et al. GLP-1 receptor localization in monkey and human tissue; Novel distribution revealed with extensively validated monoclonal antibody. Endocrinology 2014:en20131934.

Rutz S, Eidenschenk C, Ouyang W. IL-22, not simply a Th17 cytokine. Immunol Rev 2013; 252:116-32.

Sabat R, Ouyang W, Wolk K. Therapeutic opportunities of the IL-22-IL-22R1 system. Nat Rev Drug Discov 2013; 13:21-38.

Sakon S, Xue X, Takekawa M et al. NF-kappaB inhibits TNF-induced accumulation of ROS that mediate prolonged MAPK activation and necrotic cell death. EMBO 2003; 22:3898-909.

Schneider S, Ueberberg S, Korobeynikov A et al. Synthesis and evaluation of a glibenclamide glucose-conjugate: a potential new lead compound for substituted glibenclamide derivatives as islet imaging agents. Regul Pept 2007; 139:122-7.

Seino S. Cell signalling in insulin secretion: the molecular targets of ATP, cAMP and sulfonylurea. Diabetologia 2012; 55:2096-108.

Shioya M, Andoh A, Kakinoki S et al. Interleukin 22 receptor 1 expression in pancreas islets. Pancreas 2008; 36:197-9.

Smith A J, Taneja T K, Mankouri J et al. Molecular cell biology of KATP channels: implications for neonatal diabetes. Expert Rev Mol Med 2007; 9:1-17.

Sugimoto K, Ogawa A, Mizoguchi E et al. IL-22 ameliorates intestinal inflammation in a mouse model of ulcerative colitis. J Clin Invest 2008; 118:534-44.

Tortosa F, Dotta F. Incretin hormones and beta-cell mass expansion: what we know and what is missing? Arch Physiol Biochem 2013; 119:161-9.

Wu P W, Li J, Kodangattil S R et al. IL-22R, IL-10R2, and IL-22BP binding sites are topologically juxtaposed on adjacent and overlapping surfaces of IL-22. J Mol Biol 2008; 382:1168-83.

Xie M H, Aggarwal S, Ho W H et al. Interleukin (IL)-22, a novel human cytokine that signals through the interferon receptor-related proteins CRF2-4 and IL-22R. J Biol Chem 2000; 275:31335-9.

Xing W W, Zou M J, Liu S et al. Interleukin-22 protects against acute alcohol-induced hepatotoxicity in mice. Biosci Biotechnol Biochem 2011; 75:1290-4.

Yang L, Zhang Y, Wang L et al. Amelioration of high fat diet induced liver lipogenesis and hepatic steatosis by interleukin-22. J Hepatol 2010; 53:339-47.

Yu L Z, Wang H Y, Yang S P et al. Expression of interleukin-22/STAT3 signaling pathway in ulcerative colitis and related carcinogenesis. World J Gastroenterol 2013; 19:2638-49.

Yusta B, Baggio L L, Estall J L et al. GLP-1 receptor activation improves beta cell function and survival following induction of endoplasmic reticulum stress. Cell Metab 2006; 4:391-406.

Zenewicz L A, Yancopoulos G D, Valenzuela D M et al. Innate and adaptive interleukin-22 protects mice from inflammatory bowel disease. Immunity 2008; 29:947-57.

Zhang S, Fujita H, Mitsui H et al. Increased Tc22 and Treg/CD8 ratio contribute to aggressive growth of transplant associated squamous cell carcinoma. PLoS One 2013; 8:e62154.

Zheng Y, Danilenko D M, Valdez P et al. Interleukin-22, a T(H)17 cytokine, mediates IL-23-induced dermal inflammation and acanthosis. Nature 2007; 445:648-51.

Zheng Y, Valdez P A, Danilenko D M et al. Interleukin-22 mediates early host defense against attaching and effacing bacterial pathogens. Nat Med 2008; 14:282-9.

Zindl C L, Lai J F, Lee Y K et al. IL-22-producing neutrophils contribute to antimicrobial defense and restitution of colonic epithelial integrity during colitis. Proc Natl Acad Sci USA 2013; 110:12768-73.

SEQUENCE LISTING (288 sequences)

SEQ ID NO: 1 - DNA, 537 bp, Homo sapiens
atggccgccctgcagaaatctgtgagctctttccttatggggaccctggccaccagctgcctccttctcttggccctcttggtacagggaggagcagctgcgcccatcagctcccactgcaggcttgacaagtccaacttccagcagccctatatcaccaaccgcaccttcatgctggctaaggaggctagcttggctgataacaacacagacgttcgtctcattggggagaaactgttccacggagtcagtatgagtgagcgctgctatctgatgaagcaggtgctgaacttcacccttgaagaagtgctgttccctcaatctgataggttccagccttatatgcaggaggtggtgcccttcctggccaggctcagcaacaggctaagcacatgtcatattgaaggtgatgacctgcatatccagaggaatgtgcaaaagctgaaggacacagtgaaaaagcttggagagagtggagagatcaaagcaattggagaactggatttgctgtttatgtctctgagaaatgcctgcatt

SEQ ID NO: 2 - protein, 179 aa, Homo sapiens
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 3 - DNA, 438 bp, Homo sapiens
gcgcccatcagctcccactgcaggcttgacaagtccaacttccagcagccctatatcaccaaccgcaccttcatgctggctaaggaggctagcttggctgataacaacacagacgttcgtctcattggggagaaactgttccacggagtcagtatgagtgagcgctgctatctgatgaagcaggtgctgaacttcacccttgaagaagtgctgttccctcaatctgataggttccagccttatatgcaggaggtggtgcccttcctggccaggctcagcaacaggctaagcacatgtcatattgaaggtgatgacctgcatatccagaggaatgtgcaaaagctgaaggacacagtgaaaaagcttggagagagtggagagatcaaagcaattggagaactggatttgctgtttatgtctctgagaaatgcctgcatt

SEQ ID NO: 4 - protein, 146 aa, Homo sapiens
APISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 5 - DNA, 534 bp, Homo sapiens
atgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaac

SEQ ID NO: 6 - protein, 178 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 7 - DNA, 480 bp, Homo sapiens
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaac

SEQ ID NO: 8 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 9 - DNA, 117 bp, Homo sapiens
cacgatgaatttgagagacatgctgaagggacctttaccagtgatgtaagttcttatttggaaggccaagctgccaaggaattcattgcttggctggtgaaaggccgaggaaggcga

SEQ ID NO: 10 - protein, 39 aa, Homo sapiens
HDEFERHAEGTFTSDVSSYLEGQAAKEFIAWLVKGRGRR

SEQ ID NO: 11 - DNA, 111 bp, Artificial Sequence
  Coding sequence for GLP-1 1-37
cacgatgaatttgagagacatgctgaagggacctttaccagtgatgtaagttcttatttggaaggccaagctgccaaggaattcattgcttggctggtgaaaggccgagga

SEQ ID NO: 12 - protein, 37 aa, Artificial Sequence
  GLP-1 1-37
HDEFERHAEGTFTSDVSSYLEGQAAKEFIAWLVKGRG

SEQ ID NO: 13 - DNA, 90 bp, Artificial Sequence
  Coding sequence for GLP-1 7-36
catgctgaagggacctttaccagtgatgtaagttcttatttggaaggccaagctgccaaggaattcattgcttggctggtgaaaggccga

SEQ ID NO: 14 - protein, 30 aa, Artificial Sequence
  GLP-1 7-36
HAEGTFTSDVSSYLEGQAAKEFIAWLVKGR

SEQ ID NO: 15 - DNA, 93 bp, Artificial Sequence
  Coding sequence for GLP-1 7-37
catgctgaagggacctttaccagtgatgtaagttcttatttggaaggccaagctgccaaggaattcattgcttggctggtgaaaggccgagga

SEQ ID NO: 16 - protein, 31 aa, Artificial Sequence
  GLP-1 7-37
HAEGTFTSDVSSYLEGQAAKEFIAWLVKGRG

SEQ ID NO: 17 - DNA, 540 bp, Homo sapiens
atgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaa

SEQ ID NO: 18 - protein, 180 aa, Homo sapiens
MKSIYFVAGLFVMLVQGSWQRSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 19 - DNA, 480 bp, Homo sapiens
cgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaa

SEQ ID NO: 20 - protein, 160 aa, Homo sapiens
RSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 21 - DNA, 117 bp, Artificial Sequence
  Coding sequence for Exendin-4
catggcgaaggcacctttaccagcgatctgagcaaacagatggaagaagaagcggtgcgcctgtttattgaatggctgaaaaacggcggcccgagcagcggcgcgccgccgccgagc

SEQ ID NO: 22 - protein, 39 aa, Artificial Sequence
  Exendin-4
HGEGTFTSDLSKQMEEEAVRLFIEWLKNGGPSSGAPPPS

SEQ ID NO: 23 - DNA, 117 bp, Homo sapiens; identical to SEQ ID NO: 21

SEQ ID NO: 24 - protein, 153 aa, Homo sapiens
MVATKTFALLLLSLFLAVGLGEKKEGHFSALPSLPVGSHAKVSSPQPRGPRYAEGTFISDYSIAMDKIHQQDFVNWLLAQKGKKNDWKHNITQREARALELASQANRKEEEAVEPQSSPAKNPSDEDLLRDLLIQELLACLLDQTNLCRLRSR

SEQ ID NO: 25 - protein, 39 aa, Artificial Sequence; identical to SEQ ID NO: 22
  Exenatide
  MOD_RES (39)..(39): AMIDATION

SEQ ID NO: 26 - protein, 29 aa, Artificial Sequence
  Taspoglutide
  MOD_RES (1)..(1): METHYLATION, Aib
  MOD_RES (27)..(27): METHYLATION, Aib
  MOD_RES (29)..(29): AMIDATION
AEGTFTSDVSSYLEGQAAKEFIAWLVKAR

SEQ ID NO: 27 - protein, 32 aa, Artificial Sequence
  Liraglutide
  LIPID (21)..(21): PALMITATE
HAEGTFTSDVSSYLEGQAAKDEFIAWLVRGRG

SEQ ID NO: 28 - protein, 44 aa, Artificial Sequence
  Lixisenatide
  MOD_RES (44)..(44): AMIDATION
HGEGTFTSDLSKQMEEEAVRLFIEWLKNGGPSSGAPPSKKKKKK

SEQ ID NO: 29 - protein, 669 aa, Artificial Sequence
  Albiglutide
HGEGTFTSDVSSYLEGQAAKEFIAWLVKGRHGEGTFTSDVSSYLEGQAAKEFIAWLVKGRMKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 30 - protein, 31 aa, Artificial Sequence
  GLP-1 analog
  VARIANT (2)..(2): X = G or V
HXEGTFTSDVSSYLEGQAAKEFIAWLVKGGG

SEQ ID NO: 31 - protein, 31 aa, Artificial Sequence
  GLP-1 analog
  VARIANT (2)..(2): X = G or V
HXEGTFTSDVSSYLEGQAAKEFIAWLKNGGG

SEQ ID NO: 32 - protein, 31 aa, Artificial Sequence
  GLP-1 analog
  VARIANT (2)..(2): X = G or V
HXEGTFTSDVSSYLEGQAAKEFIAWLVKGGP

SEQ ID NO: 33 - protein, 31 aa, Artificial Sequence
  GLP-1 analog
  VARIANT (2)..(2): X = G or V
HXEGTFTSDVSSYLEGQAAKEFIAWLKNGGP

SEQ ID NO: 34 - protein, 30 aa, Artificial Sequence
  GLP-1 analog
  VARIANT (2)..(2): X = G or V
HXEGTFTSDVSSYLEGQAAKEFIAWLVKGG

SEQ ID NO: 35 - protein, 30 aa, Artificial Sequence
  GLP-1 analog
  VARIANT (2)..(2): X = G or V
HXEGTFTSDVSSYLEGQAAKEFIAWLKNGG

SEQ ID NO: 36 - protein, 230 aa, Artificial Sequence
  Fc portion of an immunoglobulin
  VARIANT (16)..(16): X = P or E
  VARIANT (17)..(17): X = F, V or A
  VARIANT (18)..(18): X = L, E or A
  misc_feature (80)..(80): Xaa can be any naturally occurring amino acid
  VARIANT (230)..(230): X = K or is absent
AESKYGPPCPPCPAPXXXGGPSVFLFPPKPKDTLMISRTPEVTCVVVDVSQEDPEVQFNWYVDGVEVHNAKTKPREEQFXSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGX

SEQ ID NO: 37 - protein, 108 aa, Artificial Sequence
  5A10 antibody light chain variable region
QIVLTQSPAIMSASPGEKVTMTCSASSRVTYMHWYQQRSGTSPKRWIYDTSKLASGVPARFSGSGSGTSYSLTISSMEAEDAATYYCQQWGNNPQYTFGGGTRLEIKR

SEQ ID NO: 38 - protein, 120 aa, Artificial Sequence
  5A10 antibody heavy chain variable region
QVTLKESGPGILQPSQTLSLTCSFSGFSLSTSGTGVGWIRQPSGKGLEWLSHIWWDDVKRYNPALKSRLTISRDTSYSQVFLRIASVDTADTATYYCARILDGTGPMDYWGQGTSVTVSS

SEQ ID NO: 39 - protein, 10 aa, Artificial Sequence
  5A10 antibody light chain CDR1
SASSRVTYMH

SEQ ID NO: 40 - protein, 7 aa, Artificial Sequence
  5A10 antibody light chain CDR2
DTSKLAS

SEQ ID NO: 41 - protein, 10 aa, Artificial Sequence
  5A10 antibody light chain CDR3
QQWGNNPQYT

SEQ ID NO: 42 - protein, 12 aa, Artificial Sequence
  5A10 antibody heavy chain CDR1
GFSLSTSGTGVG

SEQ ID NO: 43 - protein, 16 aa, Artificial Sequence
  5A10 antibody heavy chain CDR2
HIWWDDVKRYNPALKS

SEQ ID NO: 44 - protein, 10 aa, Artificial Sequence
  5A10 antibody heavy chain CDR3
ILDGTGPMDY

SEQ ID NO: 45 - protein, 248 aa, Artificial Sequence
  scFV based on 5A10  heavy and light chain variable regions
QIVLTQSPAIMSASPGEKVTMTCSASSRVTYMHWYQQRSGTSPKRWIYDTSKLASGVPARFSGSGSGTSYSLTISSMEAEDAATYYCQQWGNNPQYTFGGGTRLEIKRGGGGSGGGGSGGGGSGGGGSQVTLKESGPGILQPSQTLSLTCSFSGFSLSTSGTGVGWIRQPSGKGLEWLSHIWWDDVKRYNPALKSRLTISRDTSYSQVFLRIASVDTADTATYYCARILDGTGPMDYWGQGTSVTVSS

SEQ ID NO: 46 - protein, 120 aa, Homo sapiens
MSQKQEEENPAEETGEEKQDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAGGQV

SEQ ID NO: 47 - protein, 113 aa, Artificial Sequence
  Beta-cell antibody heavy chain variable region sequence
EVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVT

SEQ ID NO: 48 - protein, 113 aa, Artificial Sequence
  Beta-cell antibody heavy chain variable region sequence
EVQLLESGGGLVQPGGSLRLSCAASGFTFSSYAMSWVRQAPGKGLEWVSRIKIFGSKTKFADSVKGRFTISRDNSKNTLYLQMNSLRAEDTAVYYCAKHSTHFDYWGQGTLVT

SEQ ID NO: 49 - protein, 113 aa, Artificial Sequence
  Beta-cell antibody heavy chain variable region sequence
EVQLLESGGGLVQPGGSLRLSCAASGFTFSSYAMSWVRQAPGKGLEWVSSIHPKGYPTRYADSVKGRFTISRDNSKNTLYLQMNSLRAEDTAVYYCAKSTTPFDYWGQGTLVT

SEQ ID NO: 50 - protein, 113 aa, Artificial Sequence
  Beta-cell antibody heavy chain variable region sequence
EVQLLESGGGLVQPGGSLRLSCAASGFTFSSYAMSWVRQAPGKGLEWVSRIQFFGSHTYFADSVKGRFTISRDNSKNTLYLQMNSLRAEDTAVYYCAKHSTHFDYWGQGTLVT

SEQ ID NO: 51 - protein, 113 aa, Artificial Sequence
  Beta-cell antibody heavy chain variable region sequence
EVQLLESGGGLVQPGGSLRLSCAASGFTFSSYAMSWVRQAPGKGLEWVSSISSTGDSTSYADSVKGRFTISRDNSKNTLYLQMNSLRAEDTAVYYCAKAADSFDYWGQGTLVT

SEQ ID NO: 52 - protein, 108 aa, Artificial Sequence
  Beta-cell antibody light chain variable region sequence
DIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKR

SEQ ID NO: 53 - protein, 108 aa, Artificial Sequence
  Beta-cell antibody light chain variable region sequence
DIQMTQSPSSLSASVGDRVTITCRASQSISSYLNWYQQKPGKAPKLLIYRASSLQSGVPSRFSGSGSGTDFTLTISSLQPEDFATYYCQQLQSTPRTFGQGTKVEIKR

SEQ ID NO: 54 - protein, 108 aa, Artificial Sequence
  Beta-cell antibody light chain variable region sequence
DIQMTQSPSSLSASVGDRVTITCRASQSISSYLNWYQQKPGKAPKLLIYAASSLQSGVPSRFSGSGSGTDFTLTISSLQPEDFATYYCQQMGRDPRTFGQGTKVEIKR

SEQ ID NO: 55 - protein, 108 aa, Artificial Sequence
  Beta-cell antibody light chain variable region sequence
DIQMTQSPSSLSASVGDRVTITCRASQSISSYLNWYQQKPGKAPKLLIYRASILQSGVPSRFSGSGSGTDFTLTISSLQPEDFATYYCQQNRRIPRTFGQGTKVEIKR

SEQ ID NO: 56 - protein, 108 aa, Artificial Sequence
  Beta-cell antibody light chain variable region sequence
DIQMTQSPSSLSASVGDRVTITCRASQSISSYLNWYQQKPGKAPKLLIYGASSLQSGVPSRFSGSGSGTDFTLTISSLQPEDFATYYCQQTNGAPTTFGQGTKVEIKR

SEQ ID NO: 57 - protein, 266 aa, Artificial Sequence
  Beta-cell scFv antibody
AMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLN

SEQ ID NO: 58 - protein, 266 aa, Artificial Sequence
  Beta-cell scFv antibody
AMAEVQLLESGGGLVQPGGSLRLSCAASGFTFSSYAMSWVRQAPGKGLEWVSRIKIFGSKTKFADSVKGRFTISRDNSKNTLYLQMNSLRAEDTAVYYCAKHSTHFDYWGQGTLVTVSSGGGGSGGGGSGGGGSTDIQMTQSPSSLSASVGDRVTITCRASQSISSYLNWYQQKPGKAPKLLIYRASSLQSGVPSRFSGSGSGTDFTLTISSLQPEDFATYYCQQLQSTPRTFGQGTKVEIKRAAAHHHHHHGAAEQKLISEEDLN

SEQ ID NO: 59 - protein, 266 aa, Artificial Sequence
  Beta-cell scFv antibody
AMAEVQLLESGGGLVQPGGSLRLSCAASGFTFSSYAMSWVRQAPGKGLEWVSSIHPKGYPTRYADSVKGRFTISRDNSKNTLYLQMNSLRAEDTAVYYCAKSTTPFDYWGQGTLVTVSSGGGGSGGGGSGGGGSTDIQMTQSPSSLSASVGDRVTITCRASQSISSYLNWYQQKPGKAPKLLIYAASSLQSGVPSRFSGSGSGTDFTLTISSLQPEDFATYYCQQMGRDPRTFGQGTKVEIKRAAAHHHHHHGAAEQKLISEEDLN

SEQ ID NO: 60 - protein, 265 aa, Artificial Sequence
  Beta-cell scFv antibody
AMAEVQLLESGGGLVQPGGSLRLSCAASGFTFSSYAMSWVRQAPGKGLEWVSRIQFFGSHTYFADSVKGRFTISRDNSKNTLYLQMNSLRAEDTAVYYCAKHSTHFDYWGQGTLVTVSSGGGGSGGGGSGGGGSTDIMTQSPSSLSASVGDRVTITCRASQSISSYLNWYQQKPGKAPKLLIYRASILQSGVPSRFSGSGSGTDFTLTISSLQPEDFATYYCQQNRRIPRTFGQGTKVEIKRAAAHHHHHHGAAEQKLISEEDLN

SEQ ID NO: 61 - protein, 266 aa, Artificial Sequence
  Beta-cell scFv antibody
AMAEVQLLESGGGLVQPGGSLRLSCAASGFTFSSYAMSWVRQAPGKGLEWVSSISSTGDSTSYADSVKGRFTISRDNSKNTLYLQMNSLRAEDTAVYYCAKAADSFDYWGQGTLVTVSSGGGGSGGGGSGGGGSTDIQMTQSPSSLSASVGDRVTITCRASQSISSYLNWYQQKPGKAPKLLIYGASSLQSGVPSRFSGSGSGTDFTLTISSLQPEDFATYYCQQTNGAPTTFGQGTKVEIKRAAAHHHHHHGAAEQKLISEEDLN

SEQ ID NO: 62 - protein, 5 aa, Artificial Sequence
  Beta-cell antibody heavy chain CDR1
SYAMS

SEQ ID NO: 63 - protein, 17 aa, Artificial Sequence
  Beta-cell antibody heavy chain CDR2
SITAEGTHTWYADSVKG

SEQ ID NO: 64 - protein, 17 aa, Artificial Sequence
  Beta-cell antibody heavy chain CDR2
RIKIFGSKTKFADSVKG

SEQ ID NO: 65 - protein, 17 aa, Artificial Sequence
  Beta-cell antibody heavy chain CDR2
SIHPKGYPTRYADSVKG

SEQ ID NO: 66 - protein, 17 aa, Artificial Sequence
  Beta-cell antibody heavy chain CDR2
RIQFFGSHTYFADSVKG

SEQ ID NO: 67 - protein, 17 aa, Artificial Sequence
  Beta-cell antibody heavy chain CDR2
SISSTGDSTSYADSVKG

SEQ ID NO: 68 - protein, 7 aa, Artificial Sequence
  Beta-cell antibody heavy chain CDR3
TSYRFDY

SEQ ID NO: 69 - protein, 7 aa, Artificial Sequence
  Beta-cell antibody heavy chain CDR3
HSTHFDY

SEQ ID NO: 70 - protein, 7 aa, Artificial Sequence
  Beta-cell antibody heavy chain CDR3
STTPFDY

SEQ ID NO: 71 - protein, 7 aa, Artificial Sequence
  Beta-cell antibody heavy chain CDR3
AADSFDY

SEQ ID NO: 72 - protein, 11 aa, Artificial Sequence
  Beta-cell antibody light chain CDR1
RASQSISSYLN

SEQ ID NO: 73 - protein, 7 aa, Artificial Sequence
  Beta-cell antibody light chain CDR2
KASRLQS

SEQ ID NO: 74 - protein, 7 aa, Artificial Sequence
  Beta-cell antibody light chain CDR2
RASSLQS

SEQ ID NO: 75 - protein, 7 aa, Artificial Sequence
  Beta-cell antibody light chain CDR2
AASSLQS

SEQ ID NO: 76 - protein, 7 aa, Artificial Sequence
  Beta-cell antibody light chain CDR2
RASILQS

SEQ ID NO: 77 - protein, 7 aa, Artificial Sequence
  Beta-cell antibody light chain CDR2
GASSLQS

SEQ ID NO: 78 - protein, 9 aa, Artificial Sequence
  Beta-cell antibody light chain CDR3
QQKWDPPRT

SEQ ID NO: 79 - protein, 9 aa, Artificial Sequence
  Beta-cell antibody light chain CDR3
QQLQSTPRT

SEQ ID NO: 80 - protein, 9 aa, Artificial Sequence
  Beta-cell antibody light chain CDR3
QQMGRDPRT

SEQ ID NO: 81 - protein, 9 aa, Artificial Sequence
  Beta-cell antibody light chain CDR3
QQNRRIPRT

SEQ ID NO: 82 - protein, 9 aa, Artificial Sequence
  Beta-cell antibody light chain CDR3
QQTNGAPTT

SEQ ID NO: 83 - protein, 188 aa, Artificial Sequence
  Fusion protein comprising a GLP-1R agonist and IL-22
  MISC_FEATURE (2)..(2): Optional tag for purification
  MISC_FEATURE (42)..(42): Linker = [GGGGSGGGGSGGGGSGGGGS]n,  wherein 1 or more, suitably 1, 2, 3, 4, 5, 6, 7, 8, 9 or 10
MXHDEFERHAEGTFTSDVSSYLEGQAAKEFIAWLVKGRGRRXAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 84 - protein, 188 aa, Artificial Sequence; identical to SEQ ID NO: 83
  Fusion protein comprising a GLP-1R agonist and IL-22
  MISC_FEATURE (2)..(2): Optional tag for purification
  MISC_FEATURE (42)..(42): Linker = [GGGSGGGS]n, wherein n = 1 or more, suitably 1, 2, 3, 4, 5, 6, 7, 8, 9 or 10

SEQ ID NO: 85 - protein, 188 aa, Artificial Sequence; identical to SEQ ID NO: 83
  Fusion protein comprising a GLP-1R agonist and IL-22
  MISC_FEATURE (2)..(2): Optional tag for purification
  MISC_FEATURE (42)..(42): Linker = [GGGG]n, wherein n = n = 1 or more, suitably 1, 2, 3, 4, 5, 6, 7, 8, 9 or 10

SEQ ID NO: 86 - protein, 188 aa, Artificial Sequence; identical to SEQ ID NO: 83
  Fusion protein comprising a GLP-1R agonist and IL-22
  MISC_FEATURE (2)..(2): Optional tag for purification
  MISC_FEATURE (42)..(42): Linker = [GGGGG]n, wherein n = 1 or more, suitably 1, 2, 3, 4, 5, 6, 7, 8, 9 or 10

SEQ ID NO: 87 - protein, 188 aa, Artificial Sequence; identical to SEQ ID NO: 83
  Fusion protein comprising a GLP-1R agonist and IL-22
  MISC_FEATURE (2)..(2): Optional tag for purification
  MISC_FEATURE (42)..(42): Linker = [GGGKGGGG]n, wherein n = 1 or more, suitably 1, 2, 3, 4, 5, 6, 7, 8, 9 or 10

SEQ ID NO: 88 - protein, 188 aa, Artificial Sequence; identical to SEQ ID NO: 83
  Fusion protein comprising a GLP-1R agonist and IL-22
  MISC_FEATURE (2)..(2): Optional tag for purification
  MISC_FEATURE (42)..(42): Linker = [GGGNGSGG]n, wherein n = 1 or more, suitably 1, 2, 3, 4, 5, 6, 7, 8, 9 or 10

SEQ ID NO: 89 - protein, 188 aa, Artificial Sequence; identical to SEQ ID NO: 83
  Fusion protein comprising a GLP-1R agonist and IL-22
  MISC_FEATURE (2)..(2): Optional tag for purification
  MISC_FEATURE (42)..(42): Linker = [GGGCGGGG]n, wherein n = 1 or more, suitably 1, 2, 3, 4, 5, 6, 7, 8, 9 or 10

SEQ ID NO: 90 - protein, 188 aa, Artificial Sequence; identical to SEQ ID NO: 83
  Fusion protein comprising a GLP-1R agonist and IL-22
  MISC_FEATURE (2)..(2): Optional tag for purification
  MISC_FEATURE (42)..(42): Linker = [GPNGG]n, wherein n = 1 or more, suitably 1, 2, 3, 4, 5, 6, 7, 8, 9 or 10

SEQ ID NO: 91 - protein, 187 aa, Artificial Sequence
  Fusion protein comprising a GLP-1R agonist and IL-22
  MISC_FEATURE (2)..(2): X is an optional tag for purification
  MISC_FEATURE (2)..(2): Optional tag for purification
MXHDEFERHAEGTFTSDVSSYLEGQAAKEFIAWLVKGRGRRAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 92 - protein, 188 aa, Artificial Sequence
  Fusion protein comprising a GLP-1R agonist and IL-22
  MISC_FEATURE (2)..(2): Optional tag for purification
  MISC_FEATURE (149)..(149): Linker = [GGGGSGGGGSGGGGSGGGGS]n, wherein n = 1 or more, suitably 1, 2, 3, 4, 5, 6, 7, 8, 9 or 10
MXAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIXHDEFERHAEGTFTSDVSSYLEGQAAKEFIAWLVKGRGRR

SEQ ID NO: 93 - protein, 188 aa, Artificial Sequence; identical to SEQ ID NO: 92
  Fusion protein comprising a GLP-1R agonist and IL-22
  MISC_FEATURE (2)..(2): Optional tag for purification
  MISC_FEATURE (149)..(149): Linker = [GGGSGGGS]n, wherein n = 1 or more, suitably 1, 2, 3, 4, 5, 6, 7, 8, 9 or 10

SEQ ID NO: 94 - protein, 188 aa, Artificial Sequence; identical to SEQ ID NO: 92
  Fusion protein comprising a GLP-1R agonist and IL-22
  MISC_FEATURE (2)..(2): Optional tag for purification
  MISC_FEATURE (149)..(149): Linker = [GGGG]n, wherein n = 1 or more, suitably 1, 2, 3, 4, 5, 6, 7, 8, 9 or 10

SEQ ID NO: 95 - protein, 188 aa, Artificial Sequence; identical to SEQ ID NO: 92
  Fusion protein comprising a GLP-1R agonist and IL-22
  MISC_FEATURE (2)..(2): Optional tag for purification
  MISC_FEATURE (149)..(149): Linker = [GGGGG]n, wherein n = 1 or more, suitably 1, 2, 3, 4, 5, 6, 7, 8, 9 or 10

SEQ ID NO: 96 - protein, 188 aa, Artificial Sequence; identical to SEQ ID NO: 92
  Fusion protein comprising a GLP-1R agonist and IL-22
  MISC_FEATURE (2)..(2): Optional tag for purification
  MISC_FEATURE (149)..(149): Linker = [GGGKGGGG]n, wherein n = 1 or more, suitably 1, 2, 3, 4, 5, 6, 7, 8, 9 or 10

SEQ ID NO: 97 - protein, 188 aa, Artificial Sequence; identical to SEQ ID NO: 92
  Fusion protein comprising a GLP-1R agonist and IL-22
  MISC_FEATURE (2)..(2): Optional tag for purification
  MISC_FEATURE (149)..(149): Linker = [GGGNGSGG]n, wherein n = 1 or more, suitably 1, 2, 3, 4, 5, 6, 7, 8, 9 or 10

SEQ ID NO: 98 - protein, 188 aa, Artificial Sequence; identical to SEQ ID NO: 92
  Fusion protein comprising a GLP-1R agonist and IL-22
  MISC_FEATURE (2)..(2): Optional tag for purification
  MISC_FEATURE (149)..(149): Linker = [GGGCGGGG]n, wherein n = 1 or more, suitably 1, 2, 3, 4, 5, 6, 7, 8, 9 or 10

SEQ ID NO: 99 - protein, 188 aa, Artificial Sequence; identical to SEQ ID NO: 92
  Fusion protein comprising a GLP-1R agonist and IL-22
  MISC_FEATURE (2)..(2): Optional tag for purification
  MISC_FEATURE (149)..(149): Linker = [GPNGG]n, wherein n = 1 or more, suitably 1, 2, 3, 4, 5, 6, 7, 8, 9 or 10

SEQ ID NO: 100 - protein, 187 aa, Artificial Sequence
  Fusion protein comprising a GLP-1R agonist and IL-22
  MISC_FEATURE (2)..(2): Optional tag for purification
MXAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIHDEFERHAEGTFTSDVSSYLEGQAAKEFIAWLVKGRGRR

SEQ ID NO: 101 - protein, 186 aa, Artificial Sequence
  Fusion protein comprising a GLP-1R agonist and IL-22
  MISC_FEATURE (2)..(2): Optional tag for purification
  misc_feature (40)..(40): Xaa can be any naturally occurring amino acid
  MISC_FEATURE (49)..(49): Linker = [GGGGSGGGGSGGGGSGGGGS]n, wherein n = 1 or more, suitably 1, 2, 3, 4, 5, 6, 7, 8, 9 or 10
MXHDEFERHAEGTFTSDVSSYLEGQAAKEFIAWLVKGRGXAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 102 - protein, 186 aa, Artificial Sequence; identical to SEQ ID NO: 101
  Fusion protein comprising a GLP-1R agonist and IL-22
  MISC_FEATURE (2)..(2): Optional tag for purification
  MISC_FEATURE (40)..(40): Linker = [GGGGSGGGS]n, wherein n = 1 or more, suitably 1, 2, 3, 4, 5, 6, 7, 8, 9 or 10

SEQ ID NO: 103 - protein, 186 aa, Artificial Sequence; identical to SEQ ID NO: 101
  Fusion protein comprising a GLP-1R agonist and IL-22
  MISC_FEATURE (2)..(2): Optional tag for purification
  MISC_FEATURE (40)..(40): Linker = [GGGG]n, wherein n = 1 or more, suitably 1, 2, 3, 4, 5, 6, 7, 8, 9 or 10

SEQ ID NO: 104 - protein, 186 aa, Artificial Sequence; identical to SEQ ID NO: 101
  Fusion protein comprising a GLP-1R agonist and IL-22
  MISC_FEATURE (2)..(2): Optional tag for purification
  MISC_FEATURE (40)..(40): Linker = [GGGGGG]n, wherein n = 1 or more, suitably 1, 2, 3, 4, 5, 6, 7, 8, 9 or 10

SEQ ID NO: 105 - protein, 186 aa, Artificial Sequence; identical to SEQ ID NO: 101
  Fusion protein comprising a GLP-1R agonist and IL-22
  MISC_FEATURE (2)..(2): Optional tag for purification
  MISC_FEATURE (40)..(40): Linker = [GGGGKGGGG]n, wherein n = 1 or more, suitably 1, 2, 3, 4, 5, 6, 7, 8, 9 or 10

SEQ ID NO: 106 - protein, 186 aa, Artificial Sequence; identical to SEQ ID NO: 101
  Fusion protein comprising a GLP-1R agonist and IL-22
  MISC_FEATURE (2)..(2): Optional tag for purification
  MISC_FEATURE (40)..(40): Linker = [GGGNGSGG]n, wherein n = 1 or more, suitably 1, 2, 3, 4, 5, 6, 7, 8, 9 or 10

SEQ ID NO: 107 - protein, 186 aa, Artificial Sequence; identical to SEQ ID NO: 101
  Fusion protein comprising a GLP-1R agonist and IL-22
  MISC_FEATURE (2)..(2): Optional tag for purification
  MISC_FEATURE (40)..(40): Linker = [GGGGCGGGG]n, wherein n = 1 or more, suitably 1, 2, 3, 4, 5, 6, 7, 8, 9 or 10

SEQ ID NO: 108 - protein, 186 aa, Artificial Sequence; identical to SEQ ID NO: 101
  Fusion protein comprising a GLP-1R agonist and IL-22
  MISC_FEATURE (2)..(2): Optional tag for purification
  MISC_FEATURE (40)..(40): Linker = [GPNGG]n, wherein n = 1 or more, suitably 1, 2, 3, 4, 5, 6, 7, 8, 9 or 10

SEQ ID NO: 109 - protein, 184 aa, Artificial Sequence
  Fusion protein comprising a GLP-1R agonist and IL-22
  MISC_FEATURE (2)..(2): Optional tag for purification
MXHDEFERHAEGTFTSDVSSYLEGQAAKEFIAWLVKGRGAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNAC

SEQ ID NO: 110 - protein, 186 aa, Artificial Sequence
  Fusion protein comprising a GLP-1R agonist and IL-22
  MISC_FEATURE (2)..(2): Optional tag for purification
  MISC_FEATURE (149)..(149): Linker = [GGGGSGGGGSGGGGSGGGGS]n, wherein n = 1 or more, suitably 1, 2, 3, 4, 5, 6, 7, 8, 9 or 10
MXAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIXHDEFERHAEGTFTSDVSSYLEGQAAKEFIAWLVKGRG

SEQ ID NO: 111 - protein, 186 aa, Artificial Sequence; identical to SEQ ID NO: 110
  Fusion protein comprising a GLP-1R agonist and IL-22
  MISC_FEATURE (2)..(2): Optional tag for purification
  MISC_FEATURE (149)..(149): Linker = [GGGSGGGS]n, wherein n = 1 or more, suitably 1, 2, 3, 4, 5, 6, 7, 8, 9 or 10

SEQ ID NO: 112 - protein, 186 aa, Artificial Sequence; identical to SEQ ID NO: 110
  Fusion protein comprising a GLP-1R agonist and IL-22
  MISC_FEATURE (2)..(2): Optional tag for purification
  MISC_FEATURE (149)..(149): Linker = [GGGG]n, wherein n = 1 or more, suitably 1, 2, 3, 4, 5, 6, 7, 8, 9 or 10

SEQ ID NO: 113 - protein, 186 aa, Artificial Sequence; identical to SEQ ID NO: 110
  Fusion protein comprising a GLP-1R agonist and IL-22
  MISC_FEATURE (2)..(2): Optional tag for purification
  MISC_FEATURE (149)..(149): Linker = [GGGGG]n, wherein n = 1 or more, suitably 1, 2, 3, 4, 5, 6, 7, 8, 9 or 10

SEQ ID NO: 114 - protein, 186 aa, Artificial Sequence; identical to SEQ ID NO: 110
  Fusion protein comprising a GLP-1R agonist and IL-22
  MISC_FEATURE (2)..(2): Optional tag for purification
  MISC_FEATURE (149)..(149): Linker = [GGGKGGGG]n, wherein n = 1 or more, suitably 1, 2, 3, 4, 5, 6, 7, 8, 9 or 10

SEQ ID NO: 115 - protein, 186 aa, Artificial Sequence; identical to SEQ ID NO: 110
  Fusion protein comprising a GLP-1R agonist and IL-22
  MISC_FEATURE (2)..(2): Optional tag for purification
  MISC_FEATURE (149)..(149): Linker = [GGGNGSGG]n, wherein n = 1 or more, suitably 1, 2, 3, 4, 5, 6, 7, 8, 9 or 10

SEQ ID NO: 116 - protein, 186 aa, Artificial Sequence; identical to SEQ ID NO: 110
  Fusion protein comprising a GLP-1R agonist and IL-22
  MISC_FEATURE (2)..(2): Optional tag for purification
  MISC_FEATURE (149)..(149): Linker = [GGGCGGGG]n, wherein n = 1 or more, suitably 1, 2, 3, 4, 5, 6, 7, 8, 9 or 10

SEQ ID NO: 117 - protein, 186 aa, Artificial Sequence; identical to SEQ ID NO: 110
  Fusion protein comprising a GLP-1R agonist and IL-22
  MISC_FEATURE (2)..(2): Optional tag for purification
  MISC_FEATURE (149)..(149): Linker = [GPNGG]n, wherein n = 1 or more, suitably 1, 2, 3, 4, 5, 6, 7, 8, 9 or 10

SEQ ID NO: 118 - protein, 185 aa, Artificial Sequence
  Fusion protein comprising a GLP-1R agonist and IL-22
  MISC_FEATURE (2)..(2): Optional tag for purification
MXAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIHDEFERHAEGTFTSDVSSYLEGQAAKEFIAWLVKGRG

SEQ ID NO: 119 - protein, 179 aa, Artificial Sequence
  Fusion protein comprising a GLP-1R agonist and IL-22
  MISC_FEATURE (2)..(2): Optional tag for purification
  MISC_FEATURE (33)..(33): Linker = [GGGGSGGGGSGGGGSGGGGS]n, wherein n = 1 or more, suitably 1, 2, 3, 4, 5, 6, 7, 8, 9 or 10
MXHAEGTFTSDVSSYLEGQAAKEFIAWLVKGRXAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 120 - protein, 179 aa, Artificial Sequence; identical to SEQ ID NO: 119
  Fusion protein comprising a GLP-1R agonist and IL-22
  MISC_FEATURE (2)..(2): Optional tag for purification
  MISC_FEATURE (33)..(33): Linker = [GGGSGGGS]n, wherein n = 1 or more, suitably 1, 2, 3, 4, 5, 6, 7, 8, 9 or 10

SEQ ID NO: 121 - protein, 179 aa, Artificial Sequence; identical to SEQ ID NO: 119
  Fusion protein comprising a GLP-1R agonist and IL-22
  MISC_FEATURE (2)..(2): Optional tag for purification
  MISC_FEATURE (33)..(33): Linker = [GGGGG]n, wherein n = 1 or more, suitably 1, 2, 3, 4, 5, 6, 7, 8, 9 or 10

SEQ ID NO: 122 - protein, 179 aa, Artificial Sequence; identical to SEQ ID NO: 119
  Fusion protein comprising a GLP-1R agonist and IL-22
  MISC_FEATURE (2)..(2): Optional tag for purification
  MISC_FEATURE (33)..(33): Linker = [GGGGG]n, wherein n = 1 or more, suitably 1, 2, 3, 4, 5, 6, 7, 8, 9 or 10

SEQ ID NO: 123 - protein, 179 aa, Artificial Sequence; identical to SEQ ID NO: 119
  Fusion protein comprising a GLP-1R agonist and IL-22
  MISC_FEATURE (2)..(2): Optional tag for purification
  MISC_FEATURE (33)..(33): Linker = [GGGGKGGGG]n, wherein n = 1 or more, suitably 1, 2, 3, 4, 5, 6, 7, 8, 9 or 10

SEQ ID NO: 124 - protein, 178 aa, Artificial Sequence
  Fusion protein comprising a GLP-1R agonist and IL-22
  MISC_FEATURE (2)..(2): Optional tag for purification
  MISC_FEATURE (33)..(33): Linker = [GGGNGSGG]n, wherein n = 1 or more, suitably 1, 2, 3, 4, 5, 6, 7, 8, 9 or 10
MXHAEGTFTSDVSSYLEGQAAKEFIAWLVKGRXPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 125 - protein, 179 aa, Artificial Sequence; identical to SEQ ID NO: 119
  Fusion protein comprising a GLP-1R agonist and IL-22
  MISC_FEATURE (2)..(2): Optional tag for purification
  MISC_FEATURE (33)..(33): Linker = [GGGCGGGG]n, wherein n = 1 or more, suitably 1, 2, 3, 4, 5, 6, 7, 8, 9 or 10

SEQ ID NO: 126 - protein, 179 aa, Artificial Sequence; identical to SEQ ID NO: 119
  Fusion protein comprising a GLP-1R agonist and IL-22
  MISC_FEATURE (2)..(2): Optional tag for purification
  MISC_FEATURE (33)..(33): Linker = [GPNGG]n, wherein n = 1 or more, suitably 1, 2, 3, 4, 5, 6, 7, 8, 9 or 10

SEQ ID NO: 127 - protein, 178 aa, Artificial Sequence
  Fusion protein comprising a GLP-1R agonist and IL-22
  MISC_FEATURE (2)..(2): Optional tag for purification
MXHAEGTFTSDVSSYLEGQAAKEFIAWLVKGRAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 128 - protein, 180 aa, Artificial Sequence
  Fusion protein comprising a GLP-1R agonist and IL-22
  MISC_FEATURE (2)..(2): Optional tag for purification
  MISC_FEATURE (150)..(150): Linker = [GGGGSGGGGSGGGGSGGGGS]n, wherein n = 1 or more, suitably 1, 2, 3, 4, 5, 6, 7, 8, 9 or 10
MXHAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIXHAEGTFTSDVSSYLEGQAAKEFIAWLVKGR

SEQ ID NO: 129 - protein, 179 aa, Artificial Sequence
  Fusion protein comprising a GLP-1R agonist and IL-22
  MISC_FEATURE (2)..(2): Optional tag for purification
  MISC_FEATURE (149)..(149): Linker = [GGGSGGGS]n, wherein n = 1 or more, suitably 1, 2, 3, 4, 5, 6, 7, 8, 9 or 10
MXAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIXHAEGTFTSDVSSYLEGQAAKEFIAWLVKGR

SEQ ID NO: 130 - protein, 179 aa, Artificial Sequence; identical to SEQ ID NO: 129
  Fusion protein comprising a GLP-1R agonist and IL-22
  MISC_FEATURE (2)..(2): Optional tag for purification
  MISC_FEATURE (149)..(149): Linker = [GGGG]n, wherein n = 1 or more, suitably 1, 2, 3, 4, 5, 6, 7, 8, 9 or 10

SEQ ID NO: 131 - protein, 179 aa, Artificial Sequence; identical to SEQ ID NO: 129
  Fusion protein comprising a GLP-1R agonist and IL-22
  MISC_FEATURE (2)..(2): Optional tag for purification
  MISC_FEATURE (149)..(149): Linker = [GGGGG]n, wherein n = 1 or more, suitably 1, 2, 3, 4, 5, 6, 7, 8, 9 or 10

SEQ ID NO: 132 - protein, 179 aa, Artificial Sequence; identical to SEQ ID NO: 129
  Fusion protein comprising a GLP-1R agonist and IL-22
  MISC_FEATURE (2)..(2): Optional tag for purification
  MISC_FEATURE (149)..(149): Linker = [GGGKGGGG]n, wherein n = 1 or more, suitably 1, 2, 3, 4, 5, 6, 7, 8, 9 or 10

SEQ ID NO: 133 - protein, 179 aa, Artificial Sequence; identical to SEQ ID NO: 129
  Fusion protein comprising a GLP-1R agonist and IL-22
  MISC_FEATURE (2)..(2): Optional tag for purification
  MISC_FEATURE (149)..(149): Linker = [GGGNGSGG]n, wherein n = 1 or more, suitably 1, 2, 3, 4, 5, 6, 7, 8, 9 or 10

SEQ ID NO: 134 - protein, 179 aa, Artificial Sequence; identical to SEQ ID NO: 129
  Fusion protein comprising a GLP-1R agonist and IL-22
  MISC_FEATURE (2)..(2): Optional tag for purification
  MISC_FEATURE (149)..(149): Linker = [GGGCGGGG]n, wherein n = 1 or more, suitably 1, 2, 3, 4, 5, 6, 7, 8, 9 or 10

SEQ ID NO: 135 - protein, 179 aa, Artificial Sequence; identical to SEQ ID NO: 129
  Fusion protein comprising a GLP-1R agonist and IL-22
  MISC_FEATURE (2)..(2): Optional tag for purification
  MISC_FEATURE (149)..(149): Linker = [GPNGG]n, wherein n = 1 or more, suitably 1, 2, 3, 4, 5, 6, 7, 8, 9 or 10

SEQ ID NO: 136 - protein, 178 aa, Artificial Sequence
  Fusion protein comprising a GLP-1R agonist and IL-22
  MISC_FEATURE (2)..(2): Optional tag for purification
MXAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIHAEGTFTSDVSSYLEGQAAKEFIAWLVKGR

SEQ ID NO: 137 - protein, 397 aa, Artificial Sequence
  Fusion protein comprising an anti-GLP-1R antibody and IL-22
  MISC_FEATURE (2)..(2): Optional tag for purification
  MISC_FEATURE (251)..(251): Linker = [GGGGSGGGGSGGGGSGGGGS]n, wherein n = 1 or more, suitably 1, 2, 3, 4, 5, 6, 7, 8, 9 or 10
MXQIVLTQSPAIMSASPGEKVTMTCSASSRVTYMHWYQQRSGTSPKRWIYDTSKLASGVPARFSGSGSGTSYSLTISSMEAEDAATYYCQQWGNNPQYTFGGGTRLEIKRGGGGSGGGGSGGGGSGGGGSQVTLKESGPGILQPSQTLSLTCSFSGFSLSTSGTGVGWIRQPSGKGLEWLSHIWWDDVKRYNPALKSRLTISRDTSYSQVFLRIASVDTADTATYYCARILDGTGPMDYWGQGTSVTVSSXAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 138 - protein, 397 aa, Artificial Sequence; identical to SEQ ID NO: 137
  Fusion protein comprising an anti-GLP-1R antibody and IL-22
  MISC_FEATURE (2)..(2): Optional tag for purification
  MISC_FEATURE (251)..(251): Linker = [GGGSGGGS]n, wherein n = 1 or more, suitably 1, 2, 3, 4, 5, 6, 7, 8, 9 or 10

SEQ ID NO: 139 - protein, 397 aa, Artificial Sequence; identical to SEQ ID NO: 137
  Fusion protein comprising an anti-GLP-1R antibody and IL-22
  MISC_FEATURE (2)..(2): Optional tag for purification
  MISC_FEATURE (251)..(251): Linker = [GGGG]n, wherein n = 1 or more, suitably 1, 2, 3, 4, 5, 6, 7, 8, 9 or 10

SEQ ID NO: 140 - protein, 397 aa, Artificial Sequence; identical to SEQ ID NO: 137
  Fusion protein comprising an anti-GLP-1R antibody and IL-22
  MISC_FEATURE (2)..(2): Optional tag for purification
  MISC_FEATURE (251)..(251): Linker = [GGGGG]n, wherein n = 1 or more, suitably 1, 2, 3, 4, 5, 6, 7, 8, 9 or 10

SEQ ID NO: 141 - protein, 397 aa, Artificial Sequence; identical to SEQ ID NO: 137
  Fusion protein comprising an anti-GLP-1R antibody and IL-22
  MISC_FEATURE (2)..(2): Optional tag for purification
  MISC_FEATURE (251)..(251): Linker = [GGGGKGGGG]n, wherein n = 1 or more, suitably 1, 2, 3, 4, 5, 6, 7, 8, 9 or 10

SEQ ID NO: 142 - protein, 397 aa, Artificial Sequence; identical to SEQ ID NO: 137
  Fusion protein comprising an anti-GLP-1R antibody and IL-22
  MISC_FEATURE (2)..(2): Optional tag for purification
  MISC_FEATURE (251)..(251): Linker = [GGGNGSGG]n, wherein n = 1 or more, suitably 1, 2, 3, 4, 5, 6, 7, 8, 9 or 10

SEQ ID NO: 143 - protein, 397 aa, Artificial Sequence; identical to SEQ ID NO: 137
  Fusion protein comprising an anti-GLP-1R antibody and IL-22
  MISC_FEATURE (2)..(2): Optional tag for purification
  MISC_FEATURE (251)..(251): Linker = [GGGCGGGG]n, wherein n = 1 or more, suitably 1, 2, 3, 4, 5, 6, 7, 8, 9 or 10

SEQ ID NO: 144 - protein, 397 aa, Artificial Sequence; identical to SEQ ID NO: 137
  Fusion protein comprising an anti-GLP-1R antibody and IL-22
  MISC_FEATURE (2)..(2): Optional tag for purification
  MISC_FEATURE (251)..(251): Linker = [GPNGG]n, wherein n = 1 or more, suitably 1, 2, 3, 4, 5, 6, 7, 8, 9 or 10

SEQ ID NO: 145 - protein, 396 aa, Artificial Sequence
  Fusion protein comprising an anti-GLP-1R antibody and IL-22
  MISC_FEATURE (2)..(2): Optional tag for purification
MXQIVLTQSPAIMSASPGEKVTMTCSASSRVTYMHWYQQRSGTSPKRWIYDTSKLASGVPARFSGSGSGTSYSLTISSMEAEDAATYYCQQWGNNPQYTFGGGTRLEIKRGGGGSGGGGSGGGGSGGGGSQVTLKESGPGILQPSQTLSLTCSFSGFSLSTSGTGVGWIRQPSGKGLEWLSHIWWDDVKRYNPALKSRLTISRDTSYSQVFLRIASVDTADTATYYCARILDGTGPMDYWGQGTSVTVSSAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 146 - protein, 398 aa, Artificial Sequence
  Fusion protein comprising an anti-GLP-1R antibody and IL-22
  MISC_FEATURE (2)..(2): Optional tag for purification
  MISC_FEATURE (150)..(150): Linker = [GGGGSGGGGSGGGGSGGGGS]n, wherein n = 1 or more, suitably 1, 2, 3, 4, 5, 6, 7, 8, 9 or 10
MXHAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIXQIVLTQSPAIMSASPGEKVTMTCSASSRVTYMHWYQQRSGTSPKRWIYDTSKLASGVPARFSGSGSGTSYSLTISSMEAEDAATYYCQQWGNNPQYTFGGGTRLEIKRGGGGSGGGGSGGGGSGGGGSQVTLKESGPGILQPSQTLSLTCSFSGFSLSTSGTGVGWIRQPSGKGLEWLSHIWWDDVKRYNPALKSRLTISRDTSYSQVFLRIASVDTADTATYYCARILDGTGPMDYWGQGTSVTVSS

SEQ ID NO: 147 - protein, 397 aa, Artificial Sequence
  Fusion protein comprising an anti-GLP-1R antibody and IL-22
  MISC_FEATURE (2)..(2): Optional tag for purification
  MISC_FEATURE (149)..(149): Linker = [GGGSGGGS]n, wherein n = 1 or more, suitably 1, 2, 3, 4, 5, 6, 7, 8, 9 or 10
MXAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIXQIVLTQSPAIMSASPGEKVTMTCSASSRVTYMHWYQQRSGTSPKRWIYDTSKLASGVPARFSGSGSGTSYSLTISSMEAEDAATYYCQQWGNNPQYTFGGGTRLEIKRGGGGSGGGGSGGGGSGGGGSQVTLKESGPGILQPSQTLSLTCSFSGFSLSTSGTGVGWIRQPSGKGLEWLSHIWWDDVKRYNPALKSRLTISRDTSYSQVFLRIASVDTADTATYYCARILDGTGPMDYWGQGTSVTVSS

SEQ ID NO: 148 - protein, 397 aa, Artificial Sequence; identical to SEQ ID NO: 147
  Fusion protein comprising an anti-GLP-1R antibody and IL-22
  MISC_FEATURE (2)..(2): Optional tag for purification
  MISC_FEATURE (149)..(149): Linker = [GGGG]n, wherein n = 1 or more, suitably 1, 2, 3, 4, 5, 6, 7, 8, 9 or 10

SEQ ID NO: 149 - protein, 397 aa, Artificial Sequence; identical to SEQ ID NO: 147
  Fusion protein comprising an anti-GLP-1R antibody and IL-22
  MISC_FEATURE (2)..(2): Optional tag for purification
  MISC_FEATURE (149)..(149): Linker = [GGGGG]n, wherein n = 1 or more, suitably 1, 2, 3, 4, 5, 6, 7, 8, 9 or 10

SEQ ID NO: 150 - protein, 397 aa, Artificial Sequence; identical to SEQ ID NO: 147
  Fusion protein comprising an anti-GLP-1R antibody and IL-22
  MISC_FEATURE (2)..(2): Optional tag for purification
  MISC_FEATURE (149)..(149): Linker = [GGGKGGGG]n, wherein n = 1 or more, suitably 1, 2, 3, 4, 5, 6, 7, 8, 9 or 10

SEQ ID NO: 151 - protein, 397 aa, Artificial Sequence; identical to SEQ ID NO: 147
  Fusion protein comprising an anti-GLP-1R antibody and IL-22
  MISC_FEATURE (2)..(2): Optional tag for purification
  MISC_FEATURE (149)..(149): Linker = [GGGNGSGG]n, wherein n = 1 or more, suitably 1, 2, 3, 4, 5, 6, 7, 8, 9 or 10

SEQ ID NO: 152 - protein, 397 aa, Artificial Sequence; identical to SEQ ID NO: 147
  Fusion protein comprising an anti-GLP-1R antibody and IL-22
  MISC_FEATURE (2)..(2): Optional tag for purification
  MISC_FEATURE (149)..(149): Linker = [GGGCGGGG]n, wherein n = 1 or more, suitably 1, 2, 3, 4, 5, 6, 7, 8, 9 or 10

SEQ ID NO: 153 - protein, 397 aa, Artificial Sequence; identical to SEQ ID NO: 147
  Fusion protein comprising an anti-GLP-1R antibody and IL-22
  MISC_FEATURE (2)..(2): Optional tag for purification
  MISC_FEATURE (149)..(149): Linker = [GPNGG]n, wherein n = 1 or more, suitably 1, 2, 3, 4, 5, 6, 7, 8, 9 or 10

SEQ ID NO: 154 - protein, 396 aa, Artificial Sequence
  Fusion protein comprising an anti-GLP-1R antibody and IL-22
  MISC_FEATURE (2)..(2): Optional tag for purification
MXAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIQIVLTQSPAIMSASPGEKVTMTCSASSRVTYMHWYQQRSGTSPKRWIYDTSKLASGVPARFSGSGSGTSYSLTISSMEAEDAATYYCQQWGNNPQYTFGGGTRLEIKRGGGGSGGGGSGGGGSGGGGSQVTLKESGPGILQPSQTLSLTCSFSGFSLSTSGTGVGWIRQPSGKGLEWLSHIWWDDVKRYNPALKSRLTISRDTSYSQVFLRIASVDTADTATYYCARILDGTGPMDYWGQGTSVTVSS

SEQ ID NO: 155 - protein, 414 aa, Artificial Sequence
  Fusion protein comprising an anti-beta cell antibody and IL-22
  MISC_FEATURE (268)..(268): Linker = [GGGGSGGGGSGGGGSGGGGS]n, wherein n = 1 or more, suitably 1, 2, 3, 4, 5, 6, 7, 8, 9 or 10
MAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLNXAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 156 - protein, 414 aa, Artificial Sequence; identical to SEQ ID NO: 155
  Fusion protein comprising an anti-beta cell antibody and IL-22
  MISC_FEATURE (268)..(268): Linker = [GGGSGGGS]n, wherein n = 1 or more, suitably 1, 2, 3, 4, 5, 6, 7, 8, 9 or 10

SEQ ID NO: 157 - protein, 414 aa, Artificial Sequence; identical to SEQ ID NO: 155
  Fusion protein comprising an anti-beta cell antibody and IL-22
  MISC_FEATURE (268)..(268): Linker = [GGGG]n, wherein n = 1 or more, suitably 1, 2, 3, 4, 5, 6, 7, 8, 9 or 10

SEQ ID NO: 158 - protein, 414 aa, Artificial Sequence; identical to SEQ ID NO: 155
  Fusion protein comprising an anti-beta cell antibody and IL-22
  MISC_FEATURE (268)..(268): Linker = [GGGGG]n, wherein n = 1 or more, suitably 1, 2, 3, 4, 5, 6, 7, 8, 9 or 10

SEQ ID NO: 159 - protein, 414 aa, Artificial Sequence; identical to SEQ ID NO: 155
  Fusion protein comprising an anti-beta cell antibody and IL-22
  MISC_FEATURE (268)..(268): Linker = [GGGGKGGGG]n, wherein n = 1 or more, suitably 1, 2, 3, 4, 5, 6, 7, 8, 9 or 10

SEQ ID NO: 160 - protein, 414 aa, Artificial Sequence; identical to SEQ ID NO: 155
  Fusion protein comprising an anti-beta cell antibody and IL-22
  MISC_FEATURE (268)..(268): Linker = [GGGNGSGG]n, wherein n = 1 or more, suitably 1, 2, 3, 4, 5, 6, 7, 8, 9 or 10

SEQ ID NO: 161 - protein, 414 aa, Artificial Sequence; identical to SEQ ID NO: 155
  Fusion protein comprising an anti-beta cell antibody and IL-22
  MISC_FEATURE (268)..(268): Linker = [GGGCGGGG]n, wherein n = 1 or more, suitably 1, 2, 3, 4, 5, 6, 7, 8, 9 or 10

SEQ ID NO: 162 - protein, 414 aa, Artificial Sequence; identical to SEQ ID NO: 155
  Fusion protein comprising an anti-beta cell antibody and IL-22
  MISC_FEATURE (268)..(268): Linker = [GPNGG]n, wherein n = 1 or more, suitably 1, 2, 3, 4, 5, 6, 7, 8, 9 or 10

SEQ ID NO: 163 - protein, 413 aa, Artificial Sequence
  Fusion protein comprising an anti-beta cell antibody and IL-22
MAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLNAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 164 - protein, 414 aa, Artificial Sequence
  Fusion protein comprising an anti-beta cell antibody and IL-22
  MISC_FEATURE (148)..(148): Linker = [GGGGSGGGGSGGGGSGGGGS]n, wherein n = 1 or more, suitably 1, 2, 3, 4, 5, 6, 7, 8, 9 or 10
MAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIXAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLN

SEQ ID NO: 165 - protein, 414 aa, Artificial Sequence; identical to SEQ ID NO: 164
  Fusion protein comprising an anti-beta cell antibody and IL-22
  MISC_FEATURE (148)..(148): Linker = [GGGSGGGS]n, wherein n = 1 or more, suitably 1, 2, 3, 4, 5, 6, 7, 8, 9 or 10

SEQ ID NO: 166 - protein, 414 aa, Artificial Sequence; identical to SEQ ID NO: 164
  Fusion protein comprising an anti-beta cell antibody and IL-22
  MISC_FEATURE (148)..(148): Linker = [GGGG]n, wherein n = 1 or more, suitably 1, 2, 3, 4, 5, 6, 7, 8, 9 or 10

SEQ ID NO: 167 - protein, 414 aa, Artificial Sequence; identical to SEQ ID NO: 164
  Fusion protein comprising an anti-beta cell antibody and IL-22
  MISC_FEATURE (148)..(148): Linker = [GGGGG]n, wherein n = 1 or more, suitably 1, 2, 3, 4, 5, 6, 7, 8, 9 or 10

SEQ ID NO: 168 - protein, 414 aa, Artificial Sequence; identical to SEQ ID NO: 164
  Fusion protein comprising an anti-beta cell antibody and IL-22
  MISC_FEATURE (148)..(148): Linker = [GGGKGGGG]n, wherein n = 1 or more, suitably 1, 2, 3, 4, 5, 6, 7, 8, 9 or 10

SEQ ID NO: 169 - protein, 414 aa, Artificial Sequence; identical to SEQ ID NO: 164
  Fusion protein comprising an anti-beta cell antibody and IL-22
  MISC_FEATURE (148)..(148): Linker = [GGGNGSGG]n, wherein n = 1 or more, suitably 1, 2, 3, 4, 5, 6, 7, 8, 9 or 10

SEQ ID NO: 170 - protein, 414 aa, Artificial Sequence; identical to SEQ ID NO: 164
  Fusion protein comprising an anti-beta cell antibody and IL-22
  MISC_FEATURE (148)..(148): Linker = [GGGCGGGG]n, wherein n = 1 or more, suitably 1, 2, 3, 4, 5, 6, 7, 8, 9 or 10

SEQ ID NO: 171 - protein, 415 aa, Artificial Sequence
  Fusion protein comprising an anti-beta cell antibody and IL-22
  MISC_FEATURE (148)..(148): Linker = [GPNGG]n, wherein n = 1 or more, suitably 1, 2, 3, 4, 5, 6, 7, 8, 9 or 10
MAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIXNAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLN

SEQ ID NO: 172 - protein, 415 aa, Artificial Sequence
  Fusion protein comprising an anti-beta cell antibody and IL-22
MAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIQIAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLN

SEQ ID NO: 173 - protein, 268 aa, Artificial Sequence
  Fusion protein comprising alpha endosulfine and IL-22
  MISC_FEATURE (121)..(121): Linker = [GGGGSGGGGSGGGGSGGGGS]n, wherein n = 1 or more, suitably 1, 2, 3, 4, 5, 6, 7, 8, 9 or 10
  MISC_FEATURE (268)..(268): Optional tag for purification
MSQKQEEENPAEETGEEKQDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAGGQVXAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIX

SEQ ID NO: 174 - protein, 268 aa, Artificial Sequence; identical to SEQ ID NO: 173
  Fusion protein comprising alpha endosulfine and IL-22
  MISC_FEATURE (121)..(121): Linker = [GGGSGGGS]n, wherein n = 1 or more, suitably 1, 2, 3, 4, 5, 6, 7, 8, 9 or 10
  MISC_FEATURE (268)..(268): Optional tag for purification

SEQ ID NO: 175 - protein, 268 aa, Artificial Sequence; identical to SEQ ID NO: 173
  Fusion protein comprising alpha endosulfine and IL-22
  MISC_FEATURE (121)..(121): Linker = [GGGG]n, wherein n = 1 or more, suitably 1, 2, 3, 4, 5, 6, 7, 8, 9 or 10
  MISC_FEATURE (268)..(268): Optional tag for purification

SEQ ID NO: 176 - protein, 268 aa, Artificial Sequence; identical to SEQ ID NO: 173
  Fusion protein comprising alpha endosulfine and IL-22
  MISC_FEATURE (121)..(121): Linker = [GGGGG]n, wherein n = 1 or more, suitably 1, 2, 3, 4, 5, 6, 7, 8, 9 or 10
  MISC_FEATURE (268)..(268): Optional tag for purification

SEQ ID NO: 177 - protein, 268 aa, Artificial Sequence; identical to SEQ ID NO: 173
  Fusion protein comprising alpha endosulfine and IL-22
  MISC_FEATURE (121)..(121): Linker = [GGGKGGGG]n, wherein n = 1 or more, suitably 1, 2, 3, 4, 5, 6, 7, 8, 9 or 10
  MISC_FEATURE (268)..(268): Optional tag for purification

SEQ ID NO: 178 - protein, 268 aa, Artificial Sequence; identical to SEQ ID NO: 173
  Fusion protein comprising alpha endosulfine and IL-22
  MISC_FEATURE (121)..(121): Linker = [GGGNGSGG]n, wherein n = 1 or more, suitably 1, 2, 3, 4, 5, 6, 7, 8, 9 or 10
  MISC_FEATURE (268)..(268): Optional tag for purification

SEQ ID NO: 179 - protein, 268 aa, Artificial Sequence; identical to SEQ ID NO: 173
  Fusion protein comprising alpha endosulfine and IL-22
  MISC_FEATURE (121)..(121): Linker = [GGGCGGGG]n, wherein n = 1 or more, suitably 1, 2, 3, 4, 5, 6, 7, 8, 9 or 10
  MISC_FEATURE (268)..(268): Optional tag for purification

SEQ ID NO: 180 - protein, 268 aa, Artificial Sequence; identical to SEQ ID NO: 173
  Fusion protein comprising alpha endosulfine and IL-22
  MISC_FEATURE (121)..(121): Linker = [GPNGG]n, wherein n = 1 or more, suitably 1, 2, 3, 4, 5, 6, 7, 8, 9 or 10
  MISC_FEATURE (268)..(268): Optional tag for purification

SEQ ID NO: 181 - protein, 267 aa, Artificial Sequence
  Fusion protein comprising alpha endosulfine and IL-22
  MISC_FEATURE (267)..(267): Optional tag for purification
MSQKQEEENPAEETGEEKQDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAGGQVAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIX

SEQ ID NO: 182 - protein, 269 aa, Artificial Sequence
  Fusion protein comprising alpha endosulfine and IL-22
  MISC_FEATURE (2)..(2): Optional tag for purification
  MISC_FEATURE (150)..(150): Linker = [GGGGSGGGGSGGGGSGGGG]n, wherein n = 1 or more, suitably 1, 2, 3, 4, 5, 6, 7, 8, 9 or 10
MXHAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIXSQKQEEENPAEETGEEKQDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAGGQV

SEQ ID NO: 183 - protein, 268 aa, Artificial Sequence
  Fusion protein comprising alpha endosulfine and IL-22
  MISC_FEATURE (2)..(2): Optional tag for purification
  MISC_FEATURE (149)..(149): Linker = [GGGSGGGS]n, wherein n = 1 or more, suitably 1, 2, 3, 4, 5, 6, 7, 8, 9 or 10
MXAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIXSQKQEEENPAEETGEEKQDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAGGQV

SEQ ID NO: 184 - protein, 268 aa, Artificial Sequence; identical to SEQ ID NO: 183
  Fusion protein comprising alpha endosulfine and IL-22
  MISC_FEATURE (2)..(2): Optional tag for purification
  MISC_FEATURE (149)..(149): Linker = [GGGG]n, wherein n = 1 or more, suitably 1, 2, 3, 4, 5, 6, 7, 8, 9 or 10

SEQ ID NO: 185 - protein, 268 aa, Artificial Sequence; identical to SEQ ID NO: 183
  Fusion protein comprising alpha endosulfine and IL-22
  MISC_FEATURE (2)..(2): Optional tag for purification
  MISC_FEATURE (149)..(149): Linker = [GGGGG]n, wherein n = 1 or more, suitably 1, 2, 3, 4, 5, 6, 7, 8, 9 or 10

SEQ ID NO: 186 - protein, 268 aa, Artificial Sequence; identical to SEQ ID NO: 183
  Fusion protein comprising alpha endosulfine and IL-22
  MISC_FEATURE (2)..(2): Optional tag for purification
  MISC_FEATURE (149)..(149): Linker = [GGGKGGGG]n, wherein n = 1 or more, suitably 1, 2, 3, 4, 5, 6, 7, 8, 9 or 10

SEQ ID NO: 187 - protein, 268 aa, Artificial Sequence; identical to SEQ ID NO: 183
  Fusion protein comprising alpha endosulfine and IL-22
  MISC_FEATURE (2)..(2): Optional tag for purification
  MISC_FEATURE (149)..(149): Linker = [GGGNGSGG]n, wherein n = 1 or more, suitably 1, 2, 3, 4, 5, 6, 7, 8, 9 or 10

SEQ ID NO: 188 - protein, 268 aa, Artificial Sequence; identical to SEQ ID NO: 183
  Fusion protein comprising alpha endosulfine and IL-22
  MISC_FEATURE (2)..(2): Optional tag for purification
  MISC_FEATURE (149)..(149): Linker = [GGGCGGGG]n, wherein n = 1 or more, suitably 1, 2, 3, 4, 5, 6, 7, 8, 9 or 10

SEQ ID NO: 189 - protein, 268 aa, Artificial Sequence; identical to SEQ ID NO: 183
  Fusion protein comprising alpha endosulfine and IL-22
  MISC_FEATURE (2)..(2): Optional tag for purification
  MISC_FEATURE (149)..(149): Linker = [GPNGG]n, wherein n = 1 or more, suitably 1, 2, 3, 4, 5, 6, 7, 8, 9 or 10

SEQ ID NO: 190 - protein, 267 aa, Artificial Sequence
  Fusion protein comprising alpha endosulfine and IL-22
  MISC_FEATURE (2)..(2): Optional tag for purification
MXAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACISQKQEEENPAEETGEEKQDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAGGQV

SEQ ID NO: 191 - protein, 119 aa, Artificial Sequence
  Alpha endosulfine without initial methionine
SQKQEEENPAEETGEEKQDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAGGQV

SEQ ID NO: 192 - DNA, 18 bp, Artificial Sequence
  sXBP-1 forward primer
ctgagtccgcagcaggtg

SEQ ID NO: 193 - DNA, 21 bp, Artificial Sequence
  sXBP-1 reverse primer
tgcccaacaggatatcagact

SEQ ID NO: 194 - DNA, 20 bp, Artificial Sequence
  GRP78 forward primer
cacagtggtgcctaccaaga

SEQ ID NO: 195 - DNA, 21 bp, Artificial Sequence
  GRP78 reverse primer
tgattgtcttttgtcaggggt

SEQ ID NO: 196 - protein, 221 aa, Artificial Sequence
  IL-20RA extracellular domain
VPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAK

SEQ ID NO: 197 - protein, 203 aa, Artificial Sequence
  IL-20RB extracellular domain
DEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEAIP

SEQ ID NO: 198 - protein, 547 aa, Artificial Sequence
  Fusion protein comprising extracellular domain of IL-20RA and heavy chain of IgGgamma1
VPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 199 - protein, 307 aa, Artificial Sequence
  Fusion protein comprising extracellular domain of IL-20RB and human kappa light chain
DEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEATVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 200 - protein, 124 aa, Artificial Sequence
  Anti-IL-23 antibody heavy chain variable domain sequence
QVQLVESGGGVVQPGRSLRLSCAASGFTFSSYGMHWVRQAPGKGLEWVAVIWYDGSNEYYADSVKGRFTISRDNSKNTLYLQMNSLRAEDTAVYYCARDRGYTSSWYPDAFDIWGQGTMVTVSS

SEQ ID NO: 201 - protein, 111 aa, Artificial Sequence
  Anti-IL-23 antibody light chain variable domain sequence
QSVLTQPPSVSGAPGQRVTISCTGSSSNTGAGYDVHWYQQVPGTAPKLLIYGSGNRPSGVPDRFSGSKSGTSASLAITGLQAEDEADYYCQSYDSSLSGWVFGGGTRLTVL

SEQ ID NO: 202 - protein, 250 aa, Artificial Sequence
  Anti-IL-23 antibody scFv
QSVLTQPPSVSGAPGQRVTISCTGSSSNTGAGYDVHWYQQVPGTAPKLLIYGSGNRPSGVPDRFSGSKSGTSASLAITGLQAEDEADYYCQSYDSSLSGWVFGGGTRLTVLGGGGSGGGGSGGGGSQVQLVESGGGVVQPGRSLRLSCAASGFTFSSYGMHWVRQAPGKGLEWVAVIWYDGSNEYYADSVKGRFTISRDNSKNTLYLQMNSLRAEDTAVYYCARDRGYTSSWYPDAFDIWGQGTMVTVSS

SEQ ID NO: 203 - protein, 11 aa, Artificial Sequence
  Anti-IL-23R antibody CDRL1
LASEDIYNNLA

SEQ ID NO: 204 - protein, 7 aa, Artificial Sequence
  Anti-IL-23R antibody CDRL2
HASSLQD

SEQ ID NO: 205 - protein, 9 aa, Artificial Sequence
  Anti-IL-23R antibody CDRL3
LQDSEYPPT

SEQ ID NO: 206 - protein, 10 aa, Artificial Sequence
  Anti-IL-23R antibody CDRH1
GFDFNSYGMS

SEQ ID NO: 207 - protein, 19 aa, Artificial Sequence
  Anti-IL-23R antibody CDRH2
DINSKSYNYATYYADSVKD

SEQ ID NO: 208 - protein, 8 aa, Artificial Sequence
  Anti-IL-23R antibody CDRH3
HHSDYFEY

SEQ ID NO: 209 - protein, 108 aa, Artificial Sequence
  Anti-IL-23R antibody light chain variable domain sequence
DIQMTQSPSSLSASVGDRVTITCLASEDIYNNLAWYQQKPGKAPKLLIYHASSLQDGVPSRFSGSGSGTDFTLTISSLQPEDFATYYCLQDSEYPPTFGQGTKVEIKR

SEQ ID NO: 210 - protein, 119 aa, Artificial Sequence
  Anti-IL-23R antibody heavy chain variable domain sequence
QVQLVESGGGVVQPGRSLRLSCAASGFDFNSYGMSWVRQAPGKGLEWVADINSKSYNYATYYADSVKDRFTISRDNSKNTLYLQMNSLRAEDTAVYYCARHHSDYFEYWGQGTLVTVSS

SEQ ID NO: 211 - protein, 242 aa, Artificial Sequence
  Anti-IL-23R antibody scFv
DIQMTQSPSSLSASVGDRVTITCLASEDIYNNLAWYQQKPGKAPKLLIYHASSLQDGVPSRFSGSGSGTDFTLTISSLQPEDFATYYCLQDSEYPPTFGQGTKVEIKRGGGGSGGGGSGGGGSQVQLVESGGGVVQPGRSLRLSCAASGFDFNSYGMSWVRQAPGKGLEWVADINSKSYNYATYYADSVKDRFTISRDNSKNTLYLQMNSLRAEDTAVYYCARHHSDYFEYWGQGTLVTVSS

SEQ ID NO: 212 - protein, 816 aa, Artificial Sequence
  Fusion protein comprising soluble IL-24 receptor and an anti-beta cell antibody
  MISC_FEATURE (2)..(2): Optional tag for purification
  MISC_FEATURE (550)..(550): Linker = [GGGGSGGGGSGGGGSGGGGS]n, wherein n = 1 or more, suitably 1, 2, 3, 4, 5, 6, 7, 8, 9 or 10
MXVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKXAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLN

SEQ ID NO: 213 - protein, 816 aa, Artificial Sequence; identical to SEQ ID NO: 212
  Fusion protein comprising soluble IL-24 receptor and an anti-beta cell antibody
  MISC_FEATURE (2)..(2): Optional tag for purification
  MISC_FEATURE (550)..(550): Linker = [GGGSGGGS]n, wherein n = 1 or more, suitably 1, 2, 3, 4, 5, 6, 7, 8, 9 or 10

SEQ ID NO: 214 - protein, 816 aa, Artificial Sequence; identical to SEQ ID NO: 212
  Fusion protein comprising soluble IL-24 receptor and an anti-beta cell antibody
  MISC_FEATURE (2)..(2): Optional tag for purification
  MISC_FEATURE (550)..(550): Linker = [GGGG]n, wherein n = 1 or more, suitably 1, 2, 3, 4, 5, 6, 7, 8, 9 or 10

SEQ ID NO: 215 - protein, 816 aa, Artificial Sequence; identical to SEQ ID NO: 212
  Fusion protein comprising soluble IL-24 receptor and an anti-beta cell antibody
  MISC_FEATURE (2)..(2): Optional tag for purification
  MISC_FEATURE (550)..(550): Linker = [GGGGG]n, wherein n = 1 or more, suitably 1, 2, 3, 4, 5, 6, 7, 8, 9 or 10

SEQ ID NO: 216 - protein, 816 aa, Artificial Sequence; identical to SEQ ID NO: 212
  Fusion protein comprising soluble IL-24 receptor and an anti-beta cell antibody
  MISC_FEATURE (2)..(2): Optional tag for purification
  MISC_FEATURE (550)..(550): Linker = [GGGKGGGG]n, wherein n = 1 or more, suitably 1, 2, 3, 4, 5, 6, 7, 8, 9 or 10

SEQ ID NO: 217 - protein, 816 aa, Artificial Sequence; identical to SEQ ID NO: 212
  Fusion protein comprising soluble IL-24 receptor and an anti-beta cell antibody
  MISC_FEATURE (2)..(2): Optional tag for purification
  MISC_FEATURE (550)..(550): Linker = [GGGNGSGG]n, wherein n = 1 or more, suitably 1, 2, 3, 4, 5, 6, 7, 8, 9 or 10

SEQ ID NO: 218 - protein, 816 aa, Artificial Sequence; identical to SEQ ID NO: 212
  Fusion protein comprising soluble IL-24 receptor and an anti-beta cell antibody
  MISC_FEATURE (2)..(2): Optional tag for purification
  MISC_FEATURE (550)..(550): Linker = [GGGCGGGG]n, wherein n = 1 or more, suitably 1, 2, 3, 4, 5, 6, 7, 8, 9 or 10

SEQ ID NO: 219 - protein, 816 aa, Artificial Sequence; identical to SEQ ID NO: 212
  Fusion protein comprising soluble IL-24 receptor and an anti-beta cell antibody
  MISC_FEATURE (2)..(2): Optional tag for purification
  MISC_FEATURE (550)..(550): Linker = [GPNGG]n, wherein n = 1 or more, suitably 1, 2, 3, 4, 5, 6, 7, 8, 9 or 10

SEQ ID NO: 220 - protein, 815 aa, Artificial Sequence
  Fusion protein comprising soluble IL-24 receptor and an anti-beta cell antibody
  MISC_FEATURE (2)..(2): Optional tag for purification
MXVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLN

SEQ ID NO: 221 - protein, 816 aa, Artificial Sequence
  Fusion protein comprising soluble IL-24 receptor and an anti-beta cell antibody
  MISC_FEATURE (2)..(2): Optional tag for purification
  MISC_FEATURE (269)..(269): Linker = [GGGGSGGGGSGGGGSGGGGS]n, wherein n = 1 or more, suitably 1, 2, 3, 4, 5, 6, 7, 8, 9 or 10
MXAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLNXVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 222 - protein, 816 aa, Artificial Sequence; identical to SEQ ID NO: 221
  Fusion protein comprising soluble IL-24 receptor and an anti-beta cell antibody
  MISC_FEATURE (2)..(2): Optional tag for purification
  MISC_FEATURE (269)..(269): Linker = [GGGSGGGS]n, wherein n = 1 or more, suitably 1, 2, 3, 4, 5, 6, 7, 8, 9 or 10

SEQ ID NO: 223 - protein, 816 aa, Artificial Sequence; identical to SEQ ID NO: 221
  Fusion protein comprising soluble IL-24 receptor and an anti-beta cell antibody
  MISC_FEATURE (2)..(2): Optional tag for purification
  MISC_FEATURE (269)..(269): Linker = [GGGG]n, wherein n = 1 or more, suitably 1, 2, 3, 4, 5, 6, 7, 8, 9 or 10

SEQ ID NO: 224 - protein, 816 aa, Artificial Sequence; identical to SEQ ID NO: 221
  Fusion protein comprising soluble IL-24 receptor and an anti-beta cell antibody
  MISC_FEATURE (2)..(2): Optional tag for purification
  MISC_FEATURE (269)..(269): Linker = [GGGGG]n, wherein n = 1 or more, suitably 1, 2, 3, 4, 5, 6, 7, 8, 9 or 10

SEQ ID NO: 225 - protein, 816 aa, Artificial Sequence; identical to SEQ ID NO: 221
  Fusion protein comprising soluble IL-24 receptor and an anti-beta cell antibody
  MISC_FEATURE (2)..(2): Optional tag for purification
  MISC_FEATURE (269)..(269): Linker = [GGGKGGGG]n, wherein n = 1 or more, suitably 1, 2, 3, 4, 5, 6, 7, 8, 9 or 10

SEQ ID NO: 226 - protein, 816 aa, Artificial Sequence; identical to SEQ ID NO: 221
  Fusion protein comprising soluble IL-24 receptor and an anti-beta cell antibody
  MISC_FEATURE (2)..(2): Optional tag for purification
  MISC_FEATURE (269)..(269): Linker = [GGGNGSGG]n, wherein n = 1 or more, suitably 1, 2, 3, 4, 5, 6, 7, 8, 9 or 10

SEQ ID NO: 227 - protein, 816 aa, Artificial Sequence; identical to SEQ ID NO: 221
  Fusion protein comprising soluble IL-24 receptor and an anti-beta cell antibody
  MISC_FEATURE (2)..(2): Optional tag for purification
  MISC_FEATURE (269)..(269): Linker = [GGGCGGGG]n, wherein n = 1 or more, suitably 1, 2, 3, 4, 5, 6, 7, 8, 9 or 10

SEQ ID NO: 228 - protein, 816 aa, Artificial Sequence; identical to SEQ ID NO: 221
  Fusion protein comprising soluble IL-24 receptor and an anti-beta cell antibody
  MISC_FEATURE (2)..(2): Optional tag for purification
  MISC_FEATURE (269)..(269): Linker = [GPNGG]n, wherein n = 1 or more, suitably 1, 2, 3, 4, 5, 6, 7, 8, 9 or 10

SEQ ID NO: 229 - protein, 815 aa, Artificial Sequence
  Fusion protein comprising soluble IL-24 receptor and an anti-beta cell antibody
  MISC_FEATURE (2)..(2): Optional tag for purification
MXAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLNVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 230 - protein, 576 aa, Artificial Sequence
  Fusion protein comprising soluble IL-24 receptor and an anti-beta cell antibody
  MISC_FEATURE (2)..(2): Optional tag for purification
  MISC_FEATURE (310)..(310): Linker = [GGGGSGGGGSGGGGSGGGGS]n, wherein n = 1 or more, suitably 1, 2, 3, 4, 5, 6, 7, 8, 9 or 10
MXDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEATVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECXAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLN

SEQ ID NO: 231 - protein, 576 aa, Artificial Sequence; identical to SEQ ID NO: 230
  Fusion protein comprising soluble IL-24 receptor and an anti-beta cell antibody
  MISC_FEATURE (2)..(2): Optional tag for purification
  MISC_FEATURE (310)..(310): Linker = [GGGSGGGS]n, wherein n = 1 or more, suitably 1, 2, 3, 4, 5, 6, 7, 8, 9 or 10

SEQ ID NO: 232 - protein, 576 aa, Artificial Sequence; identical to SEQ ID NO: 230
  Fusion protein comprising soluble IL-24 receptor and an anti-beta cell antibody
  MISC_FEATURE (2)..(2): Optional tag for purification
  MISC_FEATURE (310)..(310): Linker = [GGGG]n, wherein n = 1 or more, suitably 1, 2, 3, 4, 5, 6, 7, 8, 9 or 10

SEQ ID NO: 233 - protein, 576 aa, Artificial Sequence; identical to SEQ ID NO: 230
  Fusion protein comprising soluble IL-24 receptor and an anti-beta cell antibody
  MISC_FEATURE (2)..(2): Optional tag for purification
  MISC_FEATURE (310)..(310): Linker = [GGGGG]n, wherein n = 1 or more, suitably 1, 2, 3, 4, 5, 6, 7, 8, 9 or 10

SEQ ID NO: 234 - protein, 576 aa, Artificial Sequence; identical to SEQ ID NO: 230
  Fusion protein comprising soluble IL-24 receptor and an anti-beta cell antibody
  MISC_FEATURE (2)..(2): Optional tag for purification
  MISC_FEATURE (310)..(310): Linker = [GGGKGGGG]n, wherein n = 1 or more, suitably 1, 2, 3, 4, 5, 6, 7, 8, 9 or 10

SEQ ID NO: 235 - protein, 576 aa, Artificial Sequence; identical to SEQ ID NO: 230
  Fusion protein comprising soluble IL-24 receptor and an anti-beta cell antibody
  MISC_FEATURE (2)..(2): Optional tag for purification
  MISC_FEATURE (310)..(310): Linker = [GGGNGSGG]n, wherein n = 1 or more, suitably 1, 2, 3, 4, 5, 6, 7, 8, 9 or 10

SEQ ID NO: 236 - protein, 576 aa, Artificial Sequence; identical to SEQ ID NO: 230
  Fusion protein comprising soluble IL-24 receptor and an anti-beta cell antibody
  MISC_FEATURE (2)..(2): Optional tag for purification
  MISC_FEATURE (310)..(310): Linker = [GGGCGGGG]n, wherein n = 1 or more, suitably 1, 2, 3, 4, 5, 6, 7, 8, 9 or 10

SEQ ID NO: 237 - protein, 576 aa, Artificial Sequence; identical to SEQ ID NO: 230
  Fusion protein comprising soluble IL-24 receptor and an anti-beta cell antibody
  MISC_FEATURE (2)..(2): Optional tag for purification
  MISC_FEATURE (310)..(310): Linker = [GPNGG]n, wherein n = 1 or more, suitably 1, 2, 3, 4, 5, 6, 7, 8, 9 or 10

SEQ ID NO: 238 - protein, 575 aa, Artificial Sequence
  Fusion protein comprising soluble IL-24 receptor and an anti-beta cell antibody
  MISC_FEATURE (2)..(2): Optional tag for purification
MXDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEATVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLN

SEQ ID NO: 239 - protein, 576 aa, Artificial Sequence
  Fusion protein comprising soluble IL-24 receptor and an anti-beta cell antibody
  MISC_FEATURE (2)..(2): Optional tag for purification
  MISC_FEATURE (269)..(269): Linker = [GGGGSGGGGSGGGGSGGGGS]n, wherein n = 1 or more, suitably 1, 2, 3, 4, 5, 6, 7, 8, 9 or 10
MXAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLNXDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEATVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 240 - protein, 576 aa, Artificial Sequence; identical to SEQ ID NO: 239
  Fusion protein comprising soluble IL-24 receptor and an anti-beta cell antibody
  MISC_FEATURE (2)..(2): Optional tag for purification
  MISC_FEATURE (269)..(269): Linker = [GGGSGGGS]n, wherein n = 1 or more, suitably 1, 2, 3, 4, 5, 6, 7, 8, 9 or 10

SEQ ID NO: 241 - protein, 576 aa, Artificial Sequence; identical to SEQ ID NO: 239
  Fusion protein comprising soluble IL-24 receptor and an anti-beta cell antibody
  MISC_FEATURE (2)..(2): Optional tag for purification
  MISC_FEATURE (269)..(269): Linker = [GGGG]n, wherein n = 1 or more, suitably 1, 2, 3, 4, 5, 6, 7, 8, 9 or 10

SEQ ID NO: 242 - protein, 576 aa, Artificial Sequence; identical to SEQ ID NO: 239
  Fusion protein comprising soluble IL-24 receptor and an anti-beta cell antibody
  MISC_FEATURE (2)..(2): Optional tag for purification
  MISC_FEATURE (269)..(269): Linker = [GGGGG]n, wherein n = 1 or more, suitably 1, 2, 3, 4, 5, 6, 7, 8, 9 or 10

SEQ ID NO: 243 - protein, 576 aa, Artificial Sequence; identical to SEQ ID NO: 239
  Fusion protein comprising soluble IL-24 receptor and an anti-beta cell antibody
  MISC_FEATURE (2)..(2): Optional tag for purification
  MISC_FEATURE (269)..(269): Linker = [GGGKGGGG]n, wherein n = 1 or more, suitably 1, 2, 3, 4, 5, 6, 7, 8, 9 or 10

SEQ ID NO: 244 - protein, 576 aa, Artificial Sequence; identical to SEQ ID NO: 239
  Fusion protein comprising soluble IL-24 receptor and an anti-beta cell antibody
  MISC_FEATURE (2)..(2): Optional tag for purification
  MISC_FEATURE (269)..(269): Linker = [GGGNGSGG]n, wherein n = 1 or more, suitably 1, 2, 3, 4, 5, 6, 7, 8, 9 or 10

SEQ ID NO: 245 - protein, 576 aa, Artificial Sequence; identical to SEQ ID NO: 239
  Fusion protein comprising soluble IL-24 receptor and an anti-beta cell antibody
  MISC_FEATURE (2)..(2): Optional tag for purification
  MISC_FEATURE (269)..(269): Linker = [GGGCGGGG]n, wherein n = 1 or more, suitably 1, 2, 3, 4, 5, 6, 7, 8, 9 or 10

SEQ ID NO: 246 - protein, 576 aa, Artificial Sequence; identical to SEQ ID NO: 239
  Fusion protein comprising soluble IL-24 receptor and an anti-beta cell antibody
  MISC_FEATURE (2)..(2): Optional tag for purification
  MISC_FEATURE (269)..(269): Linker = [GPNGG]n, wherein n = 1 or more, suitably 1, 2, 3, 4, 5, 6, 7, 8, 9 or 10

SEQ ID NO: 247 - protein, 575 aa, Artificial Sequence
  Fusion protein comprising soluble IL-24 receptor and an anti-beta cell antibody
  MISC_FEATURE (2)..(2): Optional tag for purification
MXAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLNDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEATVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 248 - protein, 519 aa, Artificial Sequence
  Bi-specific antibody comprising an anti-IL-23 scFV and an anti-beta cell scFv
  MISC_FEATURE (2)..(2): Optional tag for purification
  MISC_FEATURE (253)..(253): Linker = [GGGGSGGGGSGGGGSGGGGS]n, wherein n = 1 or more, suitably 1, 2, 3, 4, 5, 6, 7, 8, 9 or 10
MXQSVLTQPPSVSGAPGQRVTISCTGSSSNTGAGYDVHWYQQVPGTAPKLLIYGSGNRPSGVPDRFSGSKSGTSASLAITGLQAEDEADYYCQSYDSSLSGWVFGGGTRLTVLGGGGSGGGGSGGGGSQVQLVESGGGVVQPGRSLRLSCAASGFTFSSYGMHWVRQAPGKGLEWVAVIWYDGSNEYYADSVKGRFTISRDNSKNTLYLQMNSLRAEDTAVYYCARDRGYTSSWYPDAFDIWGQGTMVTVSSXAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLN

SEQ ID NO: 249 - protein, 519 aa, Artificial Sequence; identical to SEQ ID NO: 248
  Bi-specific antibody comprising an anti-IL-23 scFV and an anti-beta cell scFv
  MISC_FEATURE (2)..(2): Optional tag for purification
  MISC_FEATURE (253)..(253): Linker = [GGGSGGGS]n, wherein n = 1 or more, suitably 1, 2, 3, 4, 5, 6, 7, 8, 9 or 10

SEQ ID NO: 250 - protein, 519 aa, Artificial Sequence; identical to SEQ ID NO: 248
  Bi-specific antibody comprising an anti-IL-23 scFV and an anti-beta cell scFv
  MISC_FEATURE (2)..(2): Optional tag for purification
  MISC_FEATURE (253)..(253): Linker = [GGGG]n, wherein n = 1 or more, suitably 1, 2, 3, 4, 5, 6, 7, 8, 9 or 10

SEQ ID NO: 251 - protein, 519 aa, Artificial Sequence; identical to SEQ ID NO: 248
  Bi-specific antibody comprising an anti-IL-23 scFV and an anti-beta cell scFv
  MISC_FEATURE (2)..(2): Optional tag for purification
  MISC_FEATURE (253)..(253): Linker = [GGGGG]n, wherein n = 1 or more, suitably 1, 2, 3, 4, 5, 6, 7, 8, 9 or 10

SEQ ID NO: 252 - protein, 519 aa, Artificial Sequence; identical to SEQ ID NO: 248
  Bi-specific antibody comprising an anti-IL-23 scFV and an anti-beta cell scFv
  MISC_FEATURE (2)..(2): Optional tag for purification
  MISC_FEATURE (253)..(253): Linker = [GGGKGGGG]n, wherein n = 1 or more, suitably 1, 2, 3, 4, 5, 6, 7, 8, 9 or 10

SEQ ID NO: 253 - protein, 519 aa, Artificial Sequence; identical to SEQ ID NO: 248
  Bi-specific antibody comprising an anti-IL-23 scFV and an anti-beta cell scFv
  MISC_FEATURE (2)..(2): Optional tag for purification
  MISC_FEATURE (253)..(253): Linker = [GGGNGSGG]n, wherein n = 1 or more, suitably 1, 2, 3, 4, 5, 6, 7, 8, 9 or 10

SEQ ID NO: 254 - protein, 519 aa, Artificial Sequence; identical to SEQ ID NO: 248
  Bi-specific antibody comprising an anti-IL-23 scFV and an anti-beta cell scFv
  MISC_FEATURE (2)..(2): Optional tag for purification
  MISC_FEATURE (253)..(253): Linker = [GGGCGGGG]n, wherein n = 1 or more, suitably 1, 2, 3, 4, 5, 6, 7, 8, 9 or 10

SEQ ID NO: 255 - protein, 519 aa, Artificial Sequence; identical to SEQ ID NO: 248
  Bi-specific antibody comprising an anti-IL-23 scFV and an anti-beta cell scFv
  MISC_FEATURE (2)..(2): Optional tag for purification
  MISC_FEATURE (253)..(253): Linker = [GPNGG]n, wherein n = 1 or more, suitably 1, 2, 3, 4, 5, 6, 7, 8, 9 or 10

SEQ ID NO: 256 - protein, 518 aa, Artificial Sequence
  Bi-specific antibody comprising an anti-IL-23 scFV and an anti-beta cell scFv
  MISC_FEATURE (2)..(2): Optional tag for purification
MXQSVLTQPPSVSGAPGQRVTISCTGSSSNTGAGYDVHWYQQVPGTAPKLLIYGSGNRPSGVPDRFSGSKSGTSASLAITGLQAEDEADYYCQSYDSSLSGWVFGGGTRLTVLGGGGSGGGGSGGGGSQVQLVESGGGVVQPGRSLRLSCAASGFTFSSYGMHWVRQAPGKGLEWVAVIWYDGSNEYYADSVKGRFTISRDNSKNTLYLQMNSLRAEDTAVYYCARDRGYTSSWYPDAFDIWGQGTMVTVSSAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLN

SEQ ID NO: 257 - protein, 519 aa, Artificial Sequence
  Bi-specific antibody comprising an anti-IL-23 scFV and an anti-beta cell scFv
  MISC_FEATURE (2)..(2): Optional tag for purification
  MISC_FEATURE (269)..(269): Linker = [GGGGSGGGGSGGGGSGGGGS]n, wherein n = 1 or more, suitably 1, 2, 3, 4, 5, 6, 7, 8, 9 or 10
MXAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLNXQSVLTQPPSVSGAPGQRVTISCTGSSSNTGAGYDVHWYQQVPGTAPKLLIYGSGNRPSGVPDRFSGSKSGTSASLAITGLQAEDEADYYCQSYDSSLSGWVFGGGTRLTVLGGGGSGGGGSGGGGSQVQLVESGGGVVQPGRSLRLSCAASGFTFSSYGMHWVRQAPGKGLEWVAVIWYDGSNEYYADSVKGRFTISRDNSKNTLYLQMNSLRAEDTAVYYCARDRGYTSSWYPDAFDIWGQGTMVTVSS

SEQ ID NO: 258 - protein, 519 aa, Artificial Sequence; identical to SEQ ID NO: 257
  Bi-specific antibody comprising an anti-IL-23 scFV and an anti-beta cell scFv
  MISC_FEATURE (2)..(2): Optional tag for purification
  MISC_FEATURE (269)..(269): Linker = [GGGSGGGS]n, wherein n = 1 or more, suitably 1, 2, 3, 4, 5, 6, 7, 8, 9 or 10

SEQ ID NO: 259 - protein, 519 aa, Artificial Sequence; identical to SEQ ID NO: 257
  Bi-specific antibody comprising an anti-IL-23 scFV and an anti-beta cell scFv
  MISC_FEATURE (2)..(2): Optional tag for purification
  MISC_FEATURE (269)..(269): Linker = [GGGG]n, wherein n = 1 or more, suitably 1, 2, 3, 4, 5, 6, 7, 8, 9 or 10

SEQ ID NO: 260 - protein, 519 aa, Artificial Sequence; identical to SEQ ID NO: 257
  Bi-specific antibody comprising an anti-IL-23 scFV and an anti-beta cell scFv
  MISC_FEATURE (2)..(2): Optional tag for purification
  MISC_FEATURE (269)..(269): Linker = [GGGGG]n, wherein n = 1 or more, suitably 1, 2, 3, 4, 5, 6, 7, 8, 9 or 10

SEQ ID NO: 261 - protein, 519 aa, Artificial Sequence; identical to SEQ ID NO: 257
  Bi-specific antibody comprising an anti-IL-23 scFV and an anti-beta cell scFv
  MISC_FEATURE (2)..(2): Optional tag for purification
  MISC_FEATURE (269)..(269): Linker = [GGGKGGGG]n, wherein n = 1 or more, suitably 1, 2, 3, 4, 5, 6, 7, 8, 9 or 10

SEQ ID NO: 262 - protein, 519 aa, Artificial Sequence; identical to SEQ ID NO: 257
  Bi-specific antibody comprising an anti-IL-23 scFV and an anti-beta cell scFv
  MISC_FEATURE (2)..(2): Optional tag for purification
  MISC_FEATURE (269)..(269): Linker = [GGGNGSGG]n, wherein n = 1 or more, suitably 1, 2, 3, 4, 5, 6, 7, 8, 9 or 10

SEQ ID NO: 263 - protein, 519 aa, Artificial Sequence; identical to SEQ ID NO: 257
  Bi-specific antibody comprising an anti-IL-23 scFV and an anti-beta cell scFv
  MISC_FEATURE (2)..(2): Optional tag for purification
  MISC_FEATURE (269)..(269): Linker = [GGGCGGGG]n, wherein n = 1 or more, suitably 1, 2, 3, 4, 5, 6, 7, 8, 9 or 10

SEQ ID NO: 264 - protein, 519 aa, Artificial Sequence; identical to SEQ ID NO: 257
  Bi-specific antibody comprising an anti-IL-23 scFV and an anti-beta cell scFv
  MISC_FEATURE (2)..(2): Optional tag for purification
  MISC_FEATURE (269)..(269): Linker = [GPNGG]n, wherein n = 1 or more, suitably 1, 2, 3, 4, 5, 6, 7, 8, 9 or 10

SEQ ID NO: 265 - protein, 518 aa, Artificial Sequence
  Bi-specific antibody comprising an anti-IL-23 scFV and an anti-beta cell scFv
  MISC_FEATURE (2)..(2): Optional tag for purification
MXAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLNQSVLTQPPSVSGAPGQRVTISCTGSSSNTGAGYDVHWYQQVPGTAPKLLIYGSGNRPSGVPDRFSGSKSGTSASLAITGLQAEDEADYYCQSYDSSLSGWVFGGGTRLTVLGGGGSGGGGSGGGGSQVQLVESGGGVVQPGRSLRLSCAASGFTFSSYGMHWVRQAPGKGLEWVAVIWYDGSNEYYADSVKGRFTISRDNSKNTLYLQMNSLRAEDTAVYYCARDRGYTSSWYPDAFDIWGQGTMVTVSS

SEQ ID NO: 266 - protein, 511 aa, Artificial Sequence
  Bi-specific antibody comprising an anti-IL-23R scFV and an anti-beta cell scFv
  MISC_FEATURE (2)..(2): Optional tag for purification
  MISC_FEATURE (245)..(245): Linker = [GGGGSGGGGSGGGGSGGGGS]n, wherein n = 1 or more, suitably 1, 2, 3, 4, 5, 6, 7, 8, 9 or 10
MXDIQMTQSPSSLSASVGDRVTITCLASEDIYNNLAWYQQKPGKAPKLLIYHASSLQDGVPSRFSGSGSGTDFTLTISSLQPEDFATYYCLQDSEYPPTFGQGTKVEIKRGGGGSGGGGSGGGGSQVQLVESGGGVVQPGRSLRLSCAASGFDFNSYGMSWVRQAPGKGLEWVADINSKSYNYATYYADSVKDRFTISRDNSKNTLYLQMNSLRAEDTAVYYCARHHSDYFEYWGQGTLVTVSSXAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLN

SEQ ID NO: 267 - protein, 511 aa, Artificial Sequence; identical to SEQ ID NO: 266
  Bi-specific antibody comprising an anti-IL-23R scFV and an anti-beta cell scFv
  MISC_FEATURE (2)..(2): Optional tag for purification
  MISC_FEATURE (245)..(245): Linker = [GGGSGGGS]n, wherein n = 1 or more, suitably 1, 2, 3, 4, 5, 6, 7, 8, 9 or 10

SEQ ID NO: 268 - protein, 511 aa, Artificial Sequence; identical to SEQ ID NO: 266
  Bi-specific antibody comprising an anti-IL-23R scFV and an anti-beta cell scFv
  MISC_FEATURE (2)..(2): Optional tag for purification
  MISC_FEATURE (245)..(245): Linker = [GGGG]n, wherein n = 1 or more, suitably 1, 2, 3, 4, 5, 6, 7, 8, 9 or 10

SEQ ID NO: 269 - protein, 511 aa, Artificial Sequence; identical to SEQ ID NO: 266
  Bi-specific antibody comprising an anti-IL-23R scFV and an anti-beta cell scFv
  MISC_FEATURE (2)..(2): Optional tag for purification
  MISC_FEATURE (245)..(245): Linker = [GGGGG]n, wherein n = 1 or more, suitably 1, 2, 3, 4, 5, 6, 7, 8, 9 or 10

SEQ ID NO: 270 - protein, 511 aa, Artificial Sequence; identical to SEQ ID NO: 266
  Bi-specific antibody comprising an anti-IL-23R scFV and an anti-beta cell scFv
  MISC_FEATURE (2)..(2): Optional tag for purification
  MISC_FEATURE (245)..(245): Linker = [GGGKGGGG]n, wherein n = 1 or more, suitably 1, 2, 3, 4, 5, 6, 7, 8, 9 or 10

SEQ ID NO: 271 - protein, 511 aa, Artificial Sequence; identical to SEQ ID NO: 266
  Bi-specific antibody comprising an anti-IL-23R scFV and an anti-beta cell scFv
  MISC_FEATURE (2)..(2): Optional tag for purification
  MISC_FEATURE (245)..(245): Linker = [GGGNGSGG]n, wherein n = 1 or more, suitably 1, 2, 3, 4, 5, 6, 7, 8, 9 or 10

SEQ ID NO: 272 - protein, 511 aa, Artificial Sequence; identical to SEQ ID NO: 266
  Bi-specific antibody comprising an anti-IL-23R scFV and an anti-beta cell scFv
  MISC_FEATURE (2)..(2): Optional tag for purification
  MISC_FEATURE (245)..(245): Linker = [GGGCGGGG]n, wherein n = 1 or more, suitably 1, 2, 3, 4, 5, 6, 7, 8, 9 or 10

SEQ ID NO: 273 - protein, 511 aa, Artificial Sequence; identical to SEQ ID NO: 266
  Bi-specific antibody comprising an anti-IL-23R scFV and an anti-beta cell scFv
  MISC_FEATURE (2)..(2): Optional tag for purification
  MISC_FEATURE (245)..(245): Linker = [GPNGG]n, wherein n = 1 or more, suitably 1, 2, 3, 4, 5, 6, 7, 8, 9 or 10

SEQ ID NO: 274 - protein, 510 aa, Artificial Sequence
  Bi-specific antibody comprising an anti-IL-23R scFV and an anti-beta cell scFv
  MISC_FEATURE (2)..(2): Optional tag for purification
MXDIQMTQSPSSLSASVGDRVTITCLASEDIYNNLAWYQQKPGKAPKLLIYHASSLQDGVPSRFSGSGSGTDFTLTISSLQPEDFATYYCLQDSEYPPTFGQGTKVEIKRGGGGSGGGGSGGGGSQVQLVESGGGVVQPGRSLRLSCAASGFDFNSYGMSWVRQAPGKGLEWVADINSKSYNYATYYADSVKDRFTISRDNSKNTLYLQMNSLRAEDTAVYYCARHHSDYFEYWGQGTLVTVSSAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLN

SEQ ID NO: 275 - protein, 511 aa, Artificial Sequence
  Bi-specific antibody comprising an anti-IL-23R scFV and an anti-beta cell scFv
  MISC_FEATURE (2)..(2): Optional tag for purification
  MISC_FEATURE (269)..(269): Linker = [GGGGSGGGGSGGGGSGGGGS]n, wherein n = 1 or more, suitably 1, 2, 3, 4, 5, 6, 7, 8, 9 or 10
MXAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLNXDIQMTQSPSSLSASVGDRVTITCLASEDIYNNLAWYQQKPGKAPKLLIYHASSLQDGVPSRFSGSGSGTDFTLTISSLQPEDFATYYCLQDSEYPPTFGQGTKVEIKRGGGGSGGGGSGGGGSQVQLVESGGGVVQPGRSLRLSCAASGFDFNSYGMSWVRQAPGKGLEWVADINSKSYNYATYYADSVKDRFTISRDNSKNTLYLQMNSLRAEDTAVYYCARHHSDYFEYWGQGTLVTVSS

SEQ ID NO: 276 - protein, 511 aa, Artificial Sequence; identical to SEQ ID NO: 275
  Bi-specific antibody comprising an anti-IL-23R scFV and an anti-beta cell scFv
  MISC_FEATURE (2)..(2): Optional tag for purification
  MISC_FEATURE (269)..(269): Linker = [GGGSGGGS]n, wherein n = 1 or more, suitably 1, 2, 3, 4, 5, 6, 7, 8, 9 or 10

SEQ ID NO: 277 - protein, 511 aa, Artificial Sequence; identical to SEQ ID NO: 275
  Bi-specific antibody comprising an anti-IL-23R scFV and an anti-beta cell scFv
  MISC_FEATURE (2)..(2): Optional tag for purification
  MISC_FEATURE (269)..(269): Linker = [GGGG]n, wherein n = 1 or more, suitably 1, 2, 3, 4, 5, 6, 7, 8, 9 or 10

SEQ ID NO: 278 - protein, 511 aa, Artificial Sequence; identical to SEQ ID NO: 275
  Bi-specific antibody comprising an anti-IL-23R scFV and an anti-beta cell scFv
  MISC_FEATURE (2)..(2): Optional tag for purification
  MISC_FEATURE (269)..(269): Linker = [GGGGG]n, wherein n = 1 or more, suitably 1, 2, 3, 4, 5, 6, 7, 8, 9 or 10

SEQ ID NO: 279 - protein, 511 aa, Artificial Sequence; identical to SEQ ID NO: 275
  Bi-specific antibody comprising an anti-IL-23R scFV and an anti-beta cell scFv
  MISC_FEATURE (2)..(2): Optional tag for purification
  MISC_FEATURE (269)..(269): Linker = [GGGKGGGG]n, wherein n = 1 or more, suitably 1, 2, 3, 4, 5, 6, 7, 8, 9 or 10

SEQ ID NO: 280 - protein, 511 aa, Artificial Sequence; identical to SEQ ID NO: 275
  Bi-specific antibody comprising an anti-IL-23R scFV and an anti-beta cell scFv
  MISC_FEATURE (2)..(2): Optional tag for purification
  MISC_FEATURE (269)..(269): Linker = [GGGNGSGG]n, wherein n = 1 or more, suitably 1, 2, 3, 4, 5, 6, 7, 8, 9 or 10

SEQ ID NO: 281 - protein, 511 aa, Artificial Sequence; identical to SEQ ID NO: 275
  Bi-specific antibody comprising an anti-IL-23R scFV and an anti-beta cell scFv
  MISC_FEATURE (2)..(2): Optional tag for purification
  MISC_FEATURE (269)..(269): Linker = [GGGCGGGG]n, wherein n = 1 or more, suitably 1, 2, 3, 4, 5, 6, 7, 8, 9 or 10

SEQ ID NO: 282 - protein, 511 aa, Artificial Sequence; identical to SEQ ID NO: 275
  Bi-specific antibody comprising an anti-IL-23R scFV and an anti-beta cell scFv
  MISC_FEATURE (2)..(2): Optional tag for purification
  MISC_FEATURE (269)..(269): Linker = [GPNGG]n, wherein n = 1 or more, suitably 1, 2, 3, 4, 5, 6, 7, 8, 9 or 10

SEQ ID NO: 283 - protein, 510 aa, Artificial Sequence
  Bi-specific antibody comprising an anti-IL-23R scFV and an anti-beta cell scFv
  MISC_FEATURE (2)..(2): Optional tag for purification
MXAMAEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRAAAHHHHHHGAAEQKLISEEDLNDIQMTQSPSSLSASVGDRVTITCLASEDIYNNLAWYQQKPGKAPKLLIYHASSLQDGVPSRFSGSGSGTDFTLTISSLQPEDFATYYCLQDSEYPPTFGQGTKVEIKRGGGGSGGGGSGGGGSQVQLVESGGGVVQPGRSLRLSCAASGFDFNSYGMSWVRQAPGKGLEWVADINSKSYNYATYYADSVKDRFTISRDNSKNTLYLQMNSLRAEDTAVYYCARHHSDYFEYWGQGTLVTVSS

SEQ ID NO: 284 - protein, 239 aa, Artificial Sequence
  ScaB1 scFv antibody
EVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKR

SEQ ID NO: 285 - protein, 408 aa, Artificial Sequence
  His-ScaB1 scFv-IL22 human-myc
HHHHHHEVQLLESGGGLVQPGGSLRLSCAASGFTFSSYAMSWVRQAPGKGLEWVSSITAEGTHTWYADSVKGRFTISRDNSKNTLYLQMNSLRAEDTAVYYCAKTSYRFDYWGQGTLVTVSSGGGGSGGGGSGGGGSDIQMTQSPSSLSASVGDRVTITCRASQSISSYLNWYQQKPGKAPKLLIYKASRLQSGVPSRFSGSGSGTDFTLTISSLQPEDFATYYCQQKWDPPRTFGQGTKVEIKRSGGGGSAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIEQKLISEEDLN

SEQ ID NO: 286 - protein, 213 aa, Artificial Sequence
  MPBS-50 - fusion protein comrpsing a GLP-1 ligand and IL-22
EGTFTSDVSSYLEGQAAKEFIAWLVKGRHGEGTFTSDVSSYLEGQAAKEFIAWLVKGRAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIGGSHHHHHH

SEQ ID NO: 287 - protein, 207 aa, Artificial Sequence
  MPBS-51 - fusion protein comrpsing a GLP-1 ligand and IL-22
EGTFTSDVSSYLEGQAAKEFIAWLVKGRGGGSSSGGGSSSGGGSSSGGGSSSGAPISSHCRLDKSNFQQPYITNRTFMLAKEASLADNNTDVRLIGEKLFHGVSMSERCYLMKQVLNFTLEEVLFPQSDRFQPYMQEWPFLARLSNRLSTCHIEGDDLHIQRNVQKLKDTVKKLGESGEIKAIGELDLLFMSLRNACIGGSHHHHHH

SEQ ID NO: 288 - protein, 210 aa, Artificial Sequence
  MPBS-52 - fusion protein comrpsing a GLP-1 ligand and IL-22
DLSKQMEEEAVRLFIEWLKNGGPSSGAPPPSGGSSSGGGSSSGGGSSSGGGSSSGAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIGGSHHHHHH

What is claimed is:

1. A therapeutic agent comprising an IL-22 polypeptide and a ligand of a β-cell receptor, wherein the IL-22 polypeptide is fused or otherwise conjugated, directly or indirectly, to the ligand.

2. The therapeutic agent of claim 1, wherein the ligand is a peptide.

3. The therapeutic agent of claim 1, wherein the β-cell receptor is a glucagon-like peptide 1 (GLP-1) receptor.

4. The therapeutic agent of claim 3, wherein the ligand comprises an amino acid sequence selected from the group consisting of SEQ ID NOS: 10, 12, 14, 16, 18, 20, 22 and 24.

5. The therapeutic agent of claim 3, wherein the ligand comprises an amino acid sequence selected from the group consisting of SEQ ID NOS: 25 to 36.

6. The therapeutic agent of claim 1, wherein the ligand is an antigen-binding molecule that binds to said β cell receptor.

7. The therapeutic agent of claim 6, wherein the antigen-binding molecule is a monoclonal antibody comprising the light chain and heavy chain variable region amino acid sequence of SEQ ID NO: 37 and 38, respectively or its antigen-binding fragments or humanized or chimeric antibodies of said monoclonal antibody or its antigen-binding fragments.

8. The therapeutic agent of claim 6, wherein the antigen-binding molecule comprises: the light chain variable region amino acid sequence as set forth in SEQ ID NO: 37; and the heavy chain variable region amino acid sequence as set forth in SEQ ID NO: 38.

9. The therapeutic agent of claim 6, wherein the antigen-binding molecule comprises light chain and heavy chain complementarity determining region (CDR) sequences of the 5A10 monoclonal antibody, wherein the light chain CDR sequences comprise CDR1 of SEQ ID NO: 39, CDR2 of SEQ ID NO: 40, and CDR3 of SEQ ID NO: 41; and the heavy chain CDR sequences comprise CDR1 of SEQ ID NO: 42, CDR2 of SEQ ID NO: 43, and CDR3 of SEQ ID NO: 44.

10. The therapeutic agent of claim 6, wherein the antigen-binding molecule comprises a heavy chain variable sequence selected from the group consisting of SEQ ID NOS: 47 to 51, and a light chain variable region selected from the group consisting of SEQ ID NOS: 52 to 56.

11. The therapeutic agent of claim 6, wherein the antigen-binding molecule is a single chain antibody that comprises an amino acid sequence selected from the group consisting of SEQ ID NOS: 57 to 61.

12. The therapeutic agent of claim 6, wherein the antigen-binding molecule is an antibody or antigen-binding fragment that comprises heavy chain CDR sequences comprising CDR1 of SEQ ID NO: 62, CDR2 selected from the group consisting of SEQ ID NOS: 63 to 67, and CDR3 selected from the group consisting of SEQ ID NOS: 68 to 71; and light chain CDR sequences comprising CDR1 of SEQ ID NO: 72, CDR2 selected from the group consisting of SEQ ID NOS: 73 to 77, and CDR3 selected from the group consisting of SEQ ID NOS: 78 to 82.

13. The therapeutic agent of claim 6, wherein the antibody or antigen-binding fragments comprise:

heavy chain CDR sequences comprising CDR1 of SEQ ID NO: 62, CDR2 of SEQ ID NO: 63, and CDR3 of SEQ ID NO: 68; and light chain CDR sequences comprising CDR1 of SEQ ID NO: 72, CDR2 of SEQ ID NO: 73, and CDR3 of SEQ ID NO: 78; or heavy chain CDR sequences comprising CDR1 of SEQ ID NO: 62 (SYAMS), CDR2 of SEQ ID NO: 65, and CDR3 of SEQ ID NO: 69; and light chain CDR sequences comprising CDR1 of SEQ ID NO: 72, CDR2 of SEQ ID NO: 74, and CDR3 of SEQ ID NO: 79; or heavy chain CDR sequences comprising CDR1 of SEQ ID NO: 62, CDR2 of SEQ ID NO: 64, and CDR3 of SEQ ID NO: 70; and light chain CDR sequences comprising CDR1 of SEQ ID NO: 72, CDR2 of SEQ ID NO: 75, and CDR3 of SEQ ID NO: 80; or heavy chain CDR sequences comprising CDR1 of SEQ ID NO: 62, CDR2 of SEQ ID NO: 66, and CDR3 of SEQ ID NO: 69; and light chain CDR sequences comprising CDR1 of SEQ ID NO: 72, CDR2 of SEQ ID NO: 76, and CDR3 of SEQ ID NO: 81; or heavy chain CDR sequences comprising CDR1 of SEQ ID NO: 62, CDR2 of SEQ ID NO: 67, and CDR3 of SEQ ID NO: 71; and light chain CDR sequences comprising CDR1 of SEQ ID NO: 72, CDR2 of SEQ ID NO: 77, and CDR3 of SEQ ID NO: 82.

14. A therapeutic agent comprising the amino acid sequence set forth in SEQ ID NO: 159, 164, 165, 166, 169, 171, 172, 285, 286 or 288.

15. A method for reducing oxidative and/or endoplasmic reticulum (OER) stress in a β-cell, comprising contacting the β-cell with the therapeutic agent of claim 1.

16. The method of claim 15, wherein the therapeutic agent promotes insulin secretion.

17. The method of claim 15, wherein the therapeutic agent improves the quality of insulin produced from the β-cell.

18. The method of claim 15, wherein the therapeutic agent inhibits β-cell degeneration.

* * * * *